United States Patent 12,097,253 (RSV RNA MOLECULES AND COMPOSITIONS FOR VACCINATION) - sequence listing, part 4

SEQ ID NO: 3822 - RNA, 1931 nt, synthetic construct
  misc_feature 1..1931: note = mRNA product Design i-1 comprising derived and/or modified sequence from HRSV(A2)__F-del_DSCav1_mut3 (opt4)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3823 - RNA, 1931 nt, synthetic construct
  misc_feature 1..1931: note = mRNA product Design i-1 comprising derived and/or modified sequence from HRSV(A2)__F-del_DSCav1_mut3 (opt5)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3824 - RNA, 1931 nt, synthetic construct
  misc_feature 1..1931: note = mRNA product Design i-1 comprising derived and/or modified sequence from HRSV(A2)__F-del_DSCav1_mut3 (opt6)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3825 - RNA, 1931 nt, synthetic construct
  misc_feature 1..1931: note = mRNA product Design i-1 comprising derived and/or modified sequence from HRSV(A2)__F-del_DSCav1_mut3 (opt11)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3826 - RNA, 1931 nt, synthetic construct
  misc_feature 1..1931: note = mRNA product Design i-2 comprising derived and/or modified sequence from HRSV(A2)__F-del_DSCav1_mut3 (opt1)
  source 1..1931: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3827 - RNA, 1931 nt, synthetic construct
  misc_feature 1..1931: note = mRNA product Design i-2 comprising derived and/or modified sequence from HRSV(A2)__F-del_DSCav1_mut3 (opt1)
  source 1..1931: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3828 - RNA, 1931 nt, synthetic construct
  misc_feature 1..1931: note = mRNA product Design i-2 comprising derived and/or modified sequence from HRSV(A2)__F-del_DSCav1_mut3 (opt2)
  source 1..1931: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3829 - RNA, 1931 nt, synthetic construct
  misc_feature 1..1931: note = mRNA product Design i-2 comprising derived and/or modified sequence from HRSV(A2)__F-del_DSCav1_mut3 (opt3)
  source 1..1931: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3830 - RNA, 1931 nt, synthetic construct
  misc_feature 1..1931: note = mRNA product Design i-2 comprising derived and/or modified sequence from HRSV(A2)__F-del_DSCav1_mut3 (opt4)
  source 1..1931: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3831 - RNA, 1931 nt, synthetic construct
  misc_feature 1..1931: note = mRNA product Design i-2 comprising derived and/or modified sequence from HRSV(A2)__F-del_DSCav1_mut3 (opt5)
  source 1..1931: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3832 - RNA, 1931 nt, synthetic construct
  misc_feature 1..1931: note = mRNA product Design i-2 comprising derived and/or modified sequence from HRSV(A2)__F-del_DSCav1_mut3 (opt6)
  source 1..1931: mol_type = other RNA
gggagaggcgctgcctacggaggtggcagccatctccttctcggcatcaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3833 - RNA, 1931 nt, synthetic construct
  misc_feature 1..1931: note = mRNA product Design i-2 comprising derived and/or modified sequence from HRSV(A2)__F-del_DSCav1_mut3 (opt11)
  source 1..1931: mol_type = other RNA
gggagaggcgctgcctacggaggtggcagccatctccttctcggcatcaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3834 - RNA, 1927 nt, synthetic construct
  misc_feature 1..1927: note = mRNA product Design i-2 comprising derived and/or modified sequence from HRSV(A2)__F-del_DSCav1_mut3 (opt1)
  source 1..1927: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3835 - RNA, 1927 nt, synthetic construct
  misc_feature 1..1927: note = mRNA product Design i-2 comprising derived and/or modified sequence from HRSV(A2)__F-del_DSCav1_mut3 (opt1)
  source 1..1927: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3836 - RNA, 1927 nt, synthetic construct
  misc_feature 1..1927: note = mRNA product Design i-2 comprising derived and/or modified sequence from HRSV(A2)__F-del_DSCav1_mut3 (opt2)
  source 1..1927: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3837 - RNA, 1927 nt, synthetic construct
  misc_feature 1..1927: note = mRNA product Design i-2 comprising derived and/or modified sequence from HRSV(A2)__F-del_DSCav1_mut3 (opt3)
  source 1..1927: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3838 - RNA, 1927 nt, synthetic construct
  misc_feature 1..1927: note = mRNA product Design i-2 comprising derived and/or modified sequence from HRSV(A2)__F-del_DSCav1_mut3 (opt4)
  source 1..1927: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3839 - RNA, 1927 nt, synthetic construct
  misc_feature 1..1927: note = mRNA product Design i-2 comprising derived and/or modified sequence from HRSV(A2)__F-del_DSCav1_mut3 (opt5)
  source 1..1927: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3840 - RNA, 1927 nt, synthetic construct
  misc_feature 1..1927: note = mRNA product Design i-2 comprising derived and/or modified sequence from HRSV(A2)__F-del_DSCav1_mut3 (opt6)
  source 1..1927: mol_type = other RNA
ggggcgctgcctacggaggtggcagccatctccttctcggcatcaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3841 - RNA, 1927 nt, synthetic construct
  misc_feature 1..1927: note = mRNA product Design i-2 comprising derived and/or modified sequence from HRSV(A2)__F-del_DSCav1_mut3 (opt11)
  source 1..1927: mol_type = other RNA
ggggcgctgcctacggaggtggcagccatctccttctcggcatcaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3842 - RNA, 1762 nt, synthetic construct
  misc_feature 1..1762: note = mRNA product Design i-3 comprising derived and/or modified sequence from HRSV(A2)__F-del_DSCav1_mut3 (opt1) R6775
  source 1..1762: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3843 - RNA, 1762 nt, synthetic construct
  misc_feature 1..1762: note = mRNA product Design i-3 comprising derived and/or modified sequence from HRSV(A2)__F-del_DSCav1_mut3 (opt1)
  source 1..1762: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3844 - RNA, 1762 nt, synthetic construct
  misc_feature 1..1762: note = mRNA product Design i-3 comprising derived and/or modified sequence from HRSV(A2)__F-del_DSCav1_mut3 (opt2)
  source 1..1762: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3845 - RNA, 1762 nt, synthetic construct
  misc_feature 1..1762: note = mRNA product Design i-3 comprising derived and/or modified sequence from HRSV(A2)__F-del_DSCav1_mut3 (opt3)
  source 1..1762: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3846 - RNA, 1762 nt, synthetic construct
  misc_feature 1..1762: note = mRNA product Design i-3 comprising derived and/or modified sequence from HRSV(A2)__F-del_DSCav1_mut3 (opt4)
  source 1..1762: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3847 - RNA, 1762 nt, synthetic construct
  misc_feature 1..1762: note = mRNA product Design i-3 comprising derived and/or modified sequence from HRSV(A2)__F-del_DSCav1_mut3 (opt5)
  source 1..1762: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3848 - RNA, 1762 nt, synthetic construct
  misc_feature 1..1762: note = mRNA product Design i-3 comprising derived and/or modified sequence from HRSV(A2)__F-del_DSCav1_mut3 (opt6)
  source 1..1762: mol_type = other RNA
gggagaaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3849 - RNA, 1762 nt, synthetic construct
  misc_feature 1..1762: note = mRNA product Design i-3 comprising derived and/or modified sequence from HRSV(A2)__F-del_DSCav1_mut3 (opt11)
  source 1..1762: mol_type = other RNA
gggagaaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3850 - protein, 535 aa, synthetic construct
  REGION 1..535: note = derived and/or modified protein sequence (artificial) from HRSV(A2)__F_DSCav1_mut0
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 3851 - RNA, 1608 nt, synthetic construct
  misc_feature 1..1608: note = derived and/or modified CDS sequence (opt1) from HRSV(A2)__F_DSCav1_mut0
  source 1..1608: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactga

SEQ ID NO: 3852 - RNA, 1608 nt, synthetic construct
  misc_feature 1..1608: note = derived and/or modified CDS sequence (opt1) from HRSV(A2)__F_DSCav1_mut0
  source 1..1608: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactga

SEQ ID NO: 3853 - RNA, 1608 nt, synthetic construct
  misc_feature 1..1608: note = derived and/or modified CDS sequence (opt2) from HRSV(A2)__F_DSCav1_mut0
  source 1..1608: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactga

SEQ ID NO: 3854 - RNA, 1608 nt, synthetic construct
  misc_feature 1..1608: note = derived and/or modified CDS sequence (opt3) from HRSV(A2)__F_DSCav1_mut0
  source 1..1608: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactga

SEQ ID NO: 3855 - RNA, 1608 nt, synthetic construct
  misc_feature 1..1608: note = derived and/or modified CDS sequence (opt4) from HRSV(A2)__F_DSCav1_mut0
  source 1..1608: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactga

SEQ ID NO: 3856 - RNA, 1608 nt, synthetic construct
  misc_feature 1..1608: note = derived and/or modified CDS sequence (opt5) from HRSV(A2)__F_DSCav1_mut0
  source 1..1608: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactga

SEQ ID NO: 3857 - RNA, 1608 nt, synthetic construct
  misc_feature 1..1608: note = derived and/or modified CDS sequence (opt6) from HRSV(A2)__F_DSCav1_mut0
  source 1..1608: mol_type = other RNA
atggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaa

SEQ ID NO: 3858 - RNA, 1608 nt, synthetic construct
  misc_feature 1..1608: note = derived and/or modified CDS sequence (opt11) from HRSV(A2)__F_DSCav1_mut0
  source 1..1608: mol_type = other RNA
atggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaa

SEQ ID NO: 3859 - RNA, 1884 nt, synthetic construct
  misc_feature 1..1884: note = mRNA product Design a-1 comprising derived and/or modified sequence from HRSV(A2)__F_DSCav1_mut0 (opt1)
  source 1..1884: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3860 - RNA, 1884 nt, synthetic construct
  misc_feature 1..1884: note = mRNA product Design a-1 comprising derived and/or modified sequence from HRSV(A2)__F_DSCav1_mut0 (opt1)
  source 1..1884: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3861 - RNA, 1884 nt, synthetic construct
  misc_feature 1..1884: note = mRNA product Design a-1 comprising derived and/or modified sequence from HRSV(A2)__F_DSCav1_mut0 (opt2)
  source 1..1884: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3862 - RNA, 1884 nt, synthetic construct
  misc_feature 1..1884: note = mRNA product Design a-1 comprising derived and/or modified sequence from HRSV(A2)__F_DSCav1_mut0 (opt3)
  source 1..1884: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3863 - RNA, 1884 nt, synthetic construct
  misc_feature 1..1884: note = mRNA product Design a-1 comprising derived and/or modified sequence from HRSV(A2)__F_DSCav1_mut0 (opt4)
  source 1..1884: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3864 - RNA, 1884 nt, synthetic construct
  misc_feature 1..1884: note = mRNA product Design a-1 comprising derived and/or modified sequence from HRSV(A2)__F_DSCav1_mut0 (opt5)
  source 1..1884: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3865 - RNA, 1884 nt, synthetic construct
  misc_feature 1..1884: note = mRNA product Design a-1 comprising derived and/or modified sequence from HRSV(A2)__F_DSCav1_mut0 (opt6)
  source 1..1884: mol_type = other RNA
gggagagtcccgcagtcggcgtccagcggctctgcttgttcgtgtgtgtgtcgttgcaggccttattcaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3866 - RNA, 1884 nt, synthetic construct
  misc_feature 1..1884: note = mRNA product Design a-1 comprising derived and/or modified sequence from HRSV(A2)__F_DSCav1_mut0 (opt11)
  source 1..1884: mol_type = other RNA
gggagagtcccgcagtcggcgtccagcggctctgcttgttcgtgtgtgtgtcgttgcaggccttattcaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3867 - RNA, 1903 nt, synthetic construct
  misc_feature 1..1903: note = mRNA product Design a-2 comprising derived and/or modified sequence from HRSV(A2)__F_DSCav1_mut0 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3868 - RNA, 1903 nt, synthetic construct
  misc_feature 1..1903: note = mRNA product Design a-2 comprising derived and/or modified sequence from HRSV(A2)__F_DSCav1_mut0 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3869 - RNA, 1903 nt, synthetic construct
  misc_feature 1..1903: note = mRNA product Design a-2 comprising derived and/or modified sequence from HRSV(A2)__F_DSCav1_mut0 (opt2)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3870 - RNA, 1903 nt, synthetic construct
  misc_feature 1..1903: note = mRNA product Design a-2 comprising derived and/or modified sequence from HRSV(A2)__F_DSCav1_mut0 (opt3)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3871 - RNA, 1903 nt, synthetic construct
  misc_feature 1..1903: note = mRNA product Design a-2 comprising derived and/or modified sequence from HRSV(A2)__F_DSCav1_mut0 (opt4)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3872 - RNA, 1903 nt, synthetic construct
  misc_feature 1..1903: note = mRNA product Design a-2 comprising derived and/or modified sequence from HRSV(A2)__F_DSCav1_mut0 (opt5)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3873 - RNA, 1903 nt, synthetic construct
  misc_feature 1..1903: note = mRNA product Design a-2 comprising derived and/or modified sequence from HRSV(A2)__F_DSCav1_mut0 (opt6)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3874 - RNA, 1903 nt, synthetic construct
  misc_feature 1..1903: note = mRNA product Design a-2 comprising derived and/or modified sequence from HRSV(A2)__F_DSCav1_mut0 (opt11)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3875 - RNA, 1981 nt, synthetic construct
  misc_feature 1..1981: note = mRNA product Design a-3 comprising derived and/or modified sequence from HRSV(A2)__F_DSCav1_mut0 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3876 - RNA, 1981 nt, synthetic construct
  misc_feature 1..1981: note = mRNA product Design a-3 comprising derived and/or modified sequence from HRSV(A2)__F_DSCav1_mut0 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3877 - RNA, 1981 nt, synthetic construct
  misc_feature 1..1981: note = mRNA product Design a-3 comprising derived and/or modified sequence from HRSV(A2)__F_DSCav1_mut0 (opt2)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3878 - RNA, 1981 nt, synthetic construct
  misc_feature 1..1981: note = mRNA product Design a-3 comprising derived and/or modified sequence from HRSV(A2)__F_DSCav1_mut0 (opt3)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3879 - RNA, 1981 nt, synthetic construct
  misc_feature 1..1981: note = mRNA product Design a-3 comprising derived and/or modified sequence from HRSV(A2)__F_DSCav1_mut0 (opt4)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3880 - RNA, 1981 nt, synthetic construct
  misc_feature 1..1981: note = mRNA product Design a-3 comprising derived and/or modified sequence from HRSV(A2)__F_DSCav1_mut0 (opt5)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3881 - RNA, 1981 nt, synthetic construct
  misc_feature 1..1981: note = mRNA product Design a-3 comprising derived and/or modified sequence from HRSV(A2)__F_DSCav1_mut0 (opt6)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3882 - RNA, 1981 nt, synthetic construct
  misc_feature 1..1981: note = mRNA product Design a-3 comprising derived and/or modified sequence from HRSV(A2)__F_DSCav1_mut0 (opt11)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3883 - RNA, 1930 nt, synthetic construct
  misc_feature 1..1930: note = mRNA product Design a-4 comprising derived and/or modified sequence from HRSV(A2)__F_DSCav1_mut0 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3884 - RNA, 1930 nt, synthetic construct
  misc_feature 1..1930: note = mRNA product Design a-4 comprising derived and/or modified sequence from HRSV(A2)__F_DSCav1_mut0 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3885 - RNA, 1930 nt, synthetic construct
  misc_feature 1..1930: note = mRNA product Design a-4 comprising derived and/or modified sequence from HRSV(A2)__F_DSCav1_mut0 (opt2)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3886 - RNA, 1930 nt, synthetic construct
  misc_feature 1..1930: note = mRNA product Design a-4 comprising derived and/or modified sequence from HRSV(A2)__F_DSCav1_mut0 (opt3)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3887 - RNA, 1930 nt, synthetic construct
  misc_feature 1..1930: note = mRNA product Design a-4 comprising derived and/or modified sequence from HRSV(A2)__F_DSCav1_mut0 (opt4)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3888 - RNA, 1930 nt, synthetic construct
  misc_feature 1..1930: note = mRNA product Design a-4 comprising derived and/or modified sequence from HRSV(A2)__F_DSCav1_mut0 (opt5)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3889 - RNA, 1930 nt, synthetic construct
  misc_feature 1..1930: note = mRNA product Design a-4 comprising derived and/or modified sequence from HRSV(A2)__F_DSCav1_mut0 (opt6)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3890 - RNA, 1930 nt, synthetic construct
  misc_feature 1..1930: note = mRNA product Design a-4 comprising derived and/or modified sequence from HRSV(A2)__F_DSCav1_mut0 (opt11)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3891 - RNA, 1876 nt, synthetic construct
  misc_feature 1..1876: note = mRNA product Design a-5 comprising derived and/or modified sequence from HRSV(A2)__F_DSCav1_mut0 (opt1)
  source 1..1876: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3892 - RNA, 1876 nt, synthetic construct
  misc_feature 1..1876: note = mRNA product Design a-5 comprising derived and/or modified sequence from HRSV(A2)__F_DSCav1_mut0 (opt1)
  source 1..1876: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3893 - RNA, 1876 nt, synthetic construct
  misc_feature 1..1876: note = mRNA product Design a-5 comprising derived and/or modified sequence from HRSV(A2)__F_DSCav1_mut0 (opt2)
  source 1..1876: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3894 - RNA, 1876 nt, synthetic construct
  misc_feature 1..1876: note = mRNA product Design a-5 comprising derived and/or modified sequence from HRSV(A2)__F_DSCav1_mut0 (opt3)
  source 1..1876: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3895 - RNA, 1876 nt, synthetic construct
  misc_feature 1..1876: note = mRNA product Design a-5 comprising derived and/or modified sequence from HRSV(A2)__F_DSCav1_mut0 (opt4)
  source 1..1876: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3896 - RNA, 1876 nt, synthetic construct
  misc_feature 1..1876: note = mRNA product Design a-5 comprising derived and/or modified sequence from HRSV(A2)__F_DSCav1_mut0 (opt5)
  source 1..1876: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3897 - RNA, 1876 nt, synthetic construct
  misc_feature 1..1876: note = mRNA product Design a-5 comprising derived and/or modified sequence from HRSV(A2)__F_DSCav1_mut0 (opt6)
  source 1..1876: mol_type = other RNA
gggagactttcccattctgtagcagaatttggtgttgcctgtggtcttggtcccgcggagaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3898 - RNA, 1876 nt, synthetic construct
  misc_feature 1..1876: note = mRNA product Design a-5 comprising derived and/or modified sequence from HRSV(A2)__F_DSCav1_mut0 (opt11)
  source 1..1876: mol_type = other RNA
gggagactttcccattctgtagcagaatttggtgttgcctgtggtcttggtcccgcggagaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3899 - RNA, 2057 nt, synthetic construct
  misc_feature 1..2057: note = mRNA product Design b-1 comprising derived and/or modified sequence from HRSV(A2)__F_DSCav1_mut0 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3900 - RNA, 2057 nt, synthetic construct
  misc_feature 1..2057: note = mRNA product Design b-1 comprising derived and/or modified sequence from HRSV(A2)__F_DSCav1_mut0 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3901 - RNA, 2057 nt, synthetic construct
  misc_feature 1..2057: note = mRNA product Design b-1 comprising derived and/or modified sequence from HRSV(A2)__F_DSCav1_mut0 (opt2)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3902 - RNA, 2057 nt, synthetic construct
  misc_feature 1..2057: note = mRNA product Design b-1 comprising derived and/or modified sequence from HRSV(A2)__F_DSCav1_mut0 (opt3)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3903 - RNA, 2057 nt, synthetic construct
  misc_feature 1..2057: note = mRNA product Design b-1 comprising derived and/or modified sequence from HRSV(A2)__F_DSCav1_mut0 (opt4)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3904 - RNA, 2057 nt, synthetic construct
  misc_feature 1..2057: note = mRNA product Design b-1 comprising derived and/or modified sequence from HRSV(A2)__F_DSCav1_mut0 (opt5)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3905 - RNA, 2057 nt, synthetic construct
  misc_feature 1..2057: note = mRNA product Design b-1 comprising derived and/or modified sequence from HRSV(A2)__F_DSCav1_mut0 (opt6)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3906 - RNA, 2057 nt, synthetic construct
  misc_feature 1..2057: note = mRNA product Design b-1 comprising derived and/or modified sequence from HRSV(A2)__F_DSCav1_mut0 (opt11)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3907 - RNA, 1877 nt, synthetic construct
  misc_feature 1..1877: note = mRNA product Design b-2 comprising derived and/or modified sequence from HRSV(A2)__F_DSCav1_mut0 (opt1)
  source 1..1877: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3908 - RNA, 1877 nt, synthetic construct
  misc_feature 1..1877: note = mRNA product Design b-2 comprising derived and/or modified sequence from HRSV(A2)__F_DSCav1_mut0 (opt1)
  source 1..1877: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3909 - RNA, 1877 nt, synthetic construct
  misc_feature 1..1877: note = mRNA product Design b-2 comprising derived and/or modified sequence from HRSV(A2)__F_DSCav1_mut0 (opt2)
  source 1..1877: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3910 - RNA, 1877 nt, synthetic construct
  misc_feature 1..1877: note = mRNA product Design b-2 comprising derived and/or modified sequence from HRSV(A2)__F_DSCav1_mut0 (opt3)
  source 1..1877: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3911 - RNA, 1877 nt, synthetic construct
  misc_feature 1..1877: note = mRNA product Design b-2 comprising derived and/or modified sequence from HRSV(A2)__F_DSCav1_mut0 (opt4)
  source 1..1877: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3912 - RNA, 1877 nt, synthetic construct
  misc_feature 1..1877: note = mRNA product Design b-2 comprising derived and/or modified sequence from HRSV(A2)__F_DSCav1_mut0 (opt5)
  source 1..1877: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3913 - RNA, 1877 nt, synthetic construct
  misc_feature 1..1877: note = mRNA product Design b-2 comprising derived and/or modified sequence from HRSV(A2)__F_DSCav1_mut0 (opt6)
  source 1..1877: mol_type = other RNA
gggagagcctctgctggagtccggggagtggcgttggctgctagagcgaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3914 - RNA, 1877 nt, synthetic construct
  misc_feature 1..1877: note = mRNA product Design b-2 comprising derived and/or modified sequence from HRSV(A2)__F_DSCav1_mut0 (opt11)
  source 1..1877: mol_type = other RNA
gggagagcctctgctggagtccggggagtggcgttggctgctagagcgaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3915 - RNA, 1897 nt, synthetic construct
  misc_feature 1..1897: note = mRNA product Design b-3 comprising derived and/or modified sequence from HRSV(A2)__F_DSCav1_mut0 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3916 - RNA, 1897 nt, synthetic construct
  misc_feature 1..1897: note = mRNA product Design b-3 comprising derived and/or modified sequence from HRSV(A2)__F_DSCav1_mut0 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3917 - RNA, 1897 nt, synthetic construct
  misc_feature 1..1897: note = mRNA product Design b-3 comprising derived and/or modified sequence from HRSV(A2)__F_DSCav1_mut0 (opt2)
  source 1..1897: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3918 - RNA, 1897 nt, synthetic construct
  misc_feature 1..1897: note = mRNA product Design b-3 comprising derived and/or modified sequence from HRSV(A2)__F_DSCav1_mut0 (opt3)
  source 1..1897: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3919 - RNA, 1897 nt, synthetic construct
  misc_feature 1..1897: note = mRNA product Design b-3 comprising derived and/or modified sequence from HRSV(A2)__F_DSCav1_mut0 (opt4)
  source 1..1897: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3920 - RNA, 1897 nt, synthetic construct
  misc_feature 1..1897: note = mRNA product Design b-3 comprising derived and/or modified sequence from HRSV(A2)__F_DSCav1_mut0 (opt5)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3921 - RNA, 1897 nt, synthetic construct
  misc_feature 1..1897: note = mRNA product Design b-3 comprising derived and/or modified sequence from HRSV(A2)__F_DSCav1_mut0 (opt6)
  source 1..1897: mol_type = other RNA
gggagagtcccgcagtcggcgtccagcggctctgcttgttcgtgtgtgtgtcgttgcaggccttattcaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3922 - RNA, 1897 nt, synthetic construct
  misc_feature 1..1897: note = mRNA product Design b-3 comprising derived and/or modified sequence from HRSV(A2)__F_DSCav1_mut0 (opt11)
  source 1..1897: mol_type = other RNA
gggagagtcccgcagtcggcgtccagcggctctgcttgttcgtgtgtgtgtcgttgcaggccttattcaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3923 - RNA, 1948 nt, synthetic construct
  misc_feature 1..1948: note = mRNA product Design b-4 comprising derived and/or modified sequence from HRSV(A2)__F_DSCav1_mut0 (opt1)
  source 1..1948: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3924 - RNA, 1948 nt, synthetic construct
  misc_feature 1..1948: note = mRNA product Design b-4 comprising derived and/or modified sequence from HRSV(A2)__F_DSCav1_mut0 (opt1)
  source 1..1948: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3925 - RNA, 1948 nt, synthetic construct
  misc_feature 1..1948: note = mRNA product Design b-4 comprising derived and/or modified sequence from HRSV(A2)__F_DSCav1_mut0 (opt2)
  source 1..1948: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3926 - RNA, 1948 nt, synthetic construct
  misc_feature 1..1948: note = mRNA product Design b-4 comprising derived and/or modified sequence from HRSV(A2)__F_DSCav1_mut0 (opt3)
  source 1..1948: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3927 - RNA, 1948 nt, synthetic construct
  misc_feature 1..1948: note = mRNA product Design b-4 comprising derived and/or modified sequence from HRSV(A2)__F_DSCav1_mut0 (opt4)
  source 1..1948: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3928 - RNA, 1948 nt, synthetic construct
  misc_feature 1..1948: note = mRNA product Design b-4 comprising derived and/or modified sequence from HRSV(A2)__F_DSCav1_mut0 (opt5)
  source 1..1948: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3929 - RNA, 1948 nt, synthetic construct
  misc_feature 1..1948: note = mRNA product Design b-4 comprising derived and/or modified sequence from HRSV(A2)__F_DSCav1_mut0 (opt6)
  source 1..1948: mol_type = other RNA
gggagagtcccgcagtcggcgtccagcggctctgcttgttcgtgtgtgtgtcgttgcaggccttattcaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3930 - RNA, 1948 nt, synthetic construct
  misc_feature 1..1948: note = mRNA product Design b-4 comprising derived and/or modified sequence from HRSV(A2)__F_DSCav1_mut0 (opt11)
  source 1..1948: mol_type = other RNA
gggagagtcccgcagtcggcgtccagcggctctgcttgttcgtgtgtgtgtcgttgcaggccttattcaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3931 - RNA, 2010 nt, synthetic construct
  misc_feature 1..2010: note = mRNA product Design b-5 comprising derived and/or modified sequence from HRSV(A2)__F_DSCav1_mut0 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3932 - RNA, 2010 nt, synthetic construct
  misc_feature 1..2010: note = mRNA product Design b-5 comprising derived and/or modified sequence from HRSV(A2)__F_DSCav1_mut0 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3933 - RNA, 2010 nt, synthetic construct
  misc_feature 1..2010: note = mRNA product Design b-5 comprising derived and/or modified sequence from HRSV(A2)__F_DSCav1_mut0 (opt2)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3934 - RNA, 2010 nt, synthetic construct
  misc_feature 1..2010: note = mRNA product Design b-5 comprising derived and/or modified sequence from HRSV(A2)__F_DSCav1_mut0 (opt3)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3935 - RNA, 2010 nt, synthetic construct
  misc_feature 1..2010: note = mRNA product Design b-5 comprising derived and/or modified sequence from HRSV(A2)__F_DSCav1_mut0 (opt4)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3936 - RNA, 2010 nt, synthetic construct
  misc_feature 1..2010: note = mRNA product Design b-5 comprising derived and/or modified sequence from HRSV(A2)__F_DSCav1_mut0 (opt5)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3937 - RNA, 2010 nt, synthetic construct
  misc_feature 1..2010: note = mRNA product Design b-5 comprising derived and/or modified sequence from HRSV(A2)__F_DSCav1_mut0 (opt6)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3938 - RNA, 2010 nt, synthetic construct
  misc_feature 1..2010: note = mRNA product Design b-5 comprising derived and/or modified sequence from HRSV(A2)__F_DSCav1_mut0 (opt11)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3939 - RNA, 1916 nt, synthetic construct
  misc_feature 1..1916: note = mRNA product Design c-1 comprising derived and/or modified sequence from HRSV(A2)__F_DSCav1_mut0 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3940 - RNA, 1916 nt, synthetic construct
  misc_feature 1..1916: note = mRNA product Design c-1 comprising derived and/or modified sequence from HRSV(A2)__F_DSCav1_mut0 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3941 - RNA, 1916 nt, synthetic construct
  misc_feature 1..1916: note = mRNA product Design c-1 comprising derived and/or modified sequence from HRSV(A2)__F_DSCav1_mut0 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3942 - RNA, 1916 nt, synthetic construct
  misc_feature 1..1916: note = mRNA product Design c-1 comprising derived and/or modified sequence from HRSV(A2)__F_DSCav1_mut0 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3943 - RNA, 1916 nt, synthetic construct
  misc_feature 1..1916: note = mRNA product Design c-1 comprising derived and/or modified sequence from HRSV(A2)__F_DSCav1_mut0 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3944 - RNA, 1916 nt, synthetic construct
  misc_feature 1..1916: note = mRNA product Design c-1 comprising derived and/or modified sequence from HRSV(A2)__F_DSCav1_mut0 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3945 - RNA, 1916 nt, synthetic construct
  misc_feature 1..1916: note = mRNA product Design c-1 comprising derived and/or modified sequence from HRSV(A2)__F_DSCav1_mut0 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3946 - RNA, 1916 nt, synthetic construct
  misc_feature 1..1916: note = mRNA product Design c-1 comprising derived and/or modified sequence from HRSV(A2)__F_DSCav1_mut0 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3947 - RNA, 2006 nt, synthetic construct
  misc_feature 1..2006: note = mRNA product Design c-2 comprising derived and/or modified sequence from HRSV(A2)__F_DSCav1_mut0 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3948 - RNA, 2006 nt, synthetic construct
  misc_feature 1..2006: note = mRNA product Design c-2 comprising derived and/or modified sequence from HRSV(A2)__F_DSCav1_mut0 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3949 - RNA, 2006 nt, synthetic construct
  misc_feature 1..2006: note = mRNA product Design c-2 comprising derived and/or modified sequence from HRSV(A2)__F_DSCav1_mut0 (opt2)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3950 - RNA, 2006 nt, synthetic construct
  misc_feature 1..2006: note = mRNA product Design c-2 comprising derived and/or modified sequence from HRSV(A2)__F_DSCav1_mut0 (opt3)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3951 - RNA, 2006 nt, synthetic construct
  misc_feature 1..2006: note = mRNA product Design c-2 comprising derived and/or modified sequence from HRSV(A2)__F_DSCav1_mut0 (opt4)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3952 - RNA, 2006 nt, synthetic construct
  misc_feature 1..2006: note = mRNA product Design c-2 comprising derived and/or modified sequence from HRSV(A2)__F_DSCav1_mut0 (opt5)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3953 - RNA, 2006 nt, synthetic construct
  misc_feature 1..2006: note = mRNA product Design c-2 comprising derived and/or modified sequence from HRSV(A2)__F_DSCav1_mut0 (opt6)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3954 - RNA, 2006 nt, synthetic construct
  misc_feature 1..2006: note = mRNA product Design c-2 comprising derived and/or modified sequence from HRSV(A2)__F_DSCav1_mut0 (opt11)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3955 - RNA, 1983 nt, synthetic construct
  misc_feature 1..1983: note = mRNA product Design c-3 comprising derived and/or modified sequence from HRSV(A2)__F_DSCav1_mut0 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3956 - RNA, 1983 nt, synthetic construct
  misc_feature 1..1983: note = mRNA product Design c-3 comprising derived and/or modified sequence from HRSV(A2)__F_DSCav1_mut0 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3957 - RNA, 1983 nt, synthetic construct
  misc_feature 1..1983: note = mRNA product Design c-3 comprising derived and/or modified sequence from HRSV(A2)__F_DSCav1_mut0 (opt2)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3958 - RNA, 1983 nt, synthetic construct
  misc_feature 1..1983: note = mRNA product Design c-3 comprising derived and/or modified sequence from HRSV(A2)__F_DSCav1_mut0 (opt3)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3959 - RNA, 1983 nt, synthetic construct
  misc_feature 1..1983: note = mRNA product Design c-3 comprising derived and/or modified sequence from HRSV(A2)__F_DSCav1_mut0 (opt4)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3960 - RNA, 1983 nt, synthetic construct
  misc_feature 1..1983: note = mRNA product Design c-3 comprising derived and/or modified sequence from HRSV(A2)__F_DSCav1_mut0 (opt5)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3961 - RNA, 1983 nt, synthetic construct
  misc_feature 1..1983: note = mRNA product Design c-3 comprising derived and/or modified sequence from HRSV(A2)__F_DSCav1_mut0 (opt6)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3962 - RNA, 1983 nt, synthetic construct
  misc_feature 1..1983: note = mRNA product Design c-3 comprising derived and/or modified sequence from HRSV(A2)__F_DSCav1_mut0 (opt11)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3963 - RNA, 1979 nt, synthetic construct
  misc_feature 1..1979: note = mRNA product Design c-4 comprising derived and/or modified sequence from HRSV(A2)__F_DSCav1_mut0 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3964 - RNA, 1979 nt, synthetic construct
  misc_feature 1..1979: note = mRNA product Design c-4 comprising derived and/or modified sequence from HRSV(A2)__F_DSCav1_mut0 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3965 - RNA, 1979 nt, synthetic construct
  misc_feature 1..1979: note = mRNA product Design c-4 comprising derived and/or modified sequence from HRSV(A2)__F_DSCav1_mut0 (opt2)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3966 - RNA, 1979 nt, synthetic construct
  misc_feature 1..1979: note = mRNA product Design c-4 comprising derived and/or modified sequence from HRSV(A2)__F_DSCav1_mut0 (opt3)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3967 - RNA, 1979 nt, synthetic construct
  misc_feature 1..1979: note = mRNA product Design c-4 comprising derived and/or modified sequence from HRSV(A2)__F_DSCav1_mut0 (opt4)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3968 - RNA, 1979 nt, synthetic construct
  misc_feature 1..1979: note = mRNA product Design c-4 comprising derived and/or modified sequence from HRSV(A2)__F_DSCav1_mut0 (opt5)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3969 - RNA, 1979 nt, synthetic construct
  misc_feature 1..1979: note = mRNA product Design c-4 comprising derived and/or modified sequence from HRSV(A2)__F_DSCav1_mut0 (opt6)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3970 - RNA, 1979 nt, synthetic construct
  misc_feature 1..1979: note = mRNA product Design c-4 comprising derived and/or modified sequence from HRSV(A2)__F_DSCav1_mut0 (opt11)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3971 - RNA, 1897 nt, synthetic construct
  misc_feature 1..1897: note = mRNA product Design c-5 comprising derived and/or modified sequence from HRSV(A2)__F_DSCav1_mut0 (opt1)
  source 1..1897: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3972 - RNA, 1897 nt, synthetic construct
  misc_feature 1..1897: note = mRNA product Design c-5 comprising derived and/or modified sequence from HRSV(A2)__F_DSCav1_mut0 (opt1)
  source 1..1897: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3973 - RNA, 1897 nt, synthetic construct
  misc_feature 1..1897: note = mRNA product Design c-5 comprising derived and/or modified sequence from HRSV(A2)__F_DSCav1_mut0 (opt2)
  source 1..1897: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3974 - RNA, 1897 nt, synthetic construct
  misc_feature 1..1897: note = mRNA product Design c-5 comprising derived and/or modified sequence from HRSV(A2)__F_DSCav1_mut0 (opt3)
  source 1..1897: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3975 - RNA, 1897 nt, synthetic construct
  misc_feature 1..1897: note = mRNA product Design c-5 comprising derived and/or modified sequence from HRSV(A2)__F_DSCav1_mut0 (opt4)
  source 1..1897: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3976 - RNA, 1897 nt, synthetic construct
  misc_feature 1..1897: note = mRNA product Design c-5 comprising derived and/or modified sequence from HRSV(A2)__F_DSCav1_mut0 (opt5)
  source 1..1897: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3977 - RNA, 1897 nt, synthetic construct
  misc_feature 1..1897: note = mRNA product Design c-5 comprising derived and/or modified sequence from HRSV(A2)__F_DSCav1_mut0 (opt6)
  source 1..1897: mol_type = other RNA
gggagagcggctcggccattttgtcccagtcagtccggaggctgcggctgcagaagtaccgcctgcggagtaactgcaaagaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3978 - RNA, 1897 nt, synthetic construct
  misc_feature 1..1897: note = mRNA product Design c-5 comprising derived and/or modified sequence from HRSV(A2)__F_DSCav1_mut0 (opt11)
  source 1..1897: mol_type = other RNA
gggagagcggctcggccattttgtcccagtcagtccggaggctgcggctgcagaagtaccgcctgcggagtaactgcaaagaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3979 - RNA, 1906 nt, synthetic construct
  misc_feature 1..1906: note = mRNA product Design d-1 comprising derived and/or modified sequence from HRSV(A2)__F_DSCav1_mut0 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3980 - RNA, 1906 nt, synthetic construct
  misc_feature 1..1906: note = mRNA product Design d-1 comprising derived and/or modified sequence from HRSV(A2)__F_DSCav1_mut0 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3981 - RNA, 1906 nt, synthetic construct
  misc_feature 1..1906: note = mRNA product Design d-1 comprising derived and/or modified sequence from HRSV(A2)__F_DSCav1_mut0 (opt2)
  source 1..1906: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3982 - RNA, 1906 nt, synthetic construct
  misc_feature 1..1906: note = mRNA product Design d-1 comprising derived and/or modified sequence from HRSV(A2)__F_DSCav1_mut0 (opt3)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3983 - RNA, 1906 nt, synthetic construct
  misc_feature 1..1906: note = mRNA product Design d-1 comprising derived and/or modified sequence from HRSV(A2)__F_DSCav1_mut0 (opt4)
  source 1..1906: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3984 - RNA, 1906 nt, synthetic construct
  misc_feature 1..1906: note = mRNA product Design d-1 comprising derived and/or modified sequence from HRSV(A2)__F_DSCav1_mut0 (opt5)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3985 - RNA, 1906 nt, synthetic construct
  misc_feature 1..1906: note = mRNA product Design d-1 comprising derived and/or modified sequence from HRSV(A2)__F_DSCav1_mut0 (opt6)
  source 1..1906: mol_type = other RNA
gggagacccgtgacccggaagttgtacggctacgcgactttccctcccacaaaccctcgcgcccttcctttcctacttgggcccggcagaaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3986 - RNA, 1906 nt, synthetic construct
  misc_feature 1..1906: note = mRNA product Design d-1 comprising derived and/or modified sequence from HRSV(A2)__F_DSCav1_mut0 (opt11)
  source 1..1906: mol_type = other RNA
gggagacccgtgacccggaagttgtacggctacgcgactttccctcccacaaaccctcgcgcccttcctttcctacttgggcccggcagaaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3987 - RNA, 1961 nt, synthetic construct
  misc_feature 1..1961: note = mRNA product Design d-2 comprising derived and/or modified sequence from HRSV(A2)__F_DSCav1_mut0 (opt1)
  source 1..1961: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3988 - RNA, 1961 nt, synthetic construct
  misc_feature 1..1961: note = mRNA product Design d-2 comprising derived and/or modified sequence from HRSV(A2)__F_DSCav1_mut0 (opt1)
  source 1..1961: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3989 - RNA, 1961 nt, synthetic construct
  misc_feature 1..1961: note = mRNA product Design d-2 comprising derived and/or modified sequence from HRSV(A2)__F_DSCav1_mut0 (opt2)
  source 1..1961: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3990 - RNA, 1961 nt, synthetic construct
  misc_feature 1..1961: note = mRNA product Design d-2 comprising derived and/or modified sequence from HRSV(A2)__F_DSCav1_mut0 (opt3)
  source 1..1961: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3991 - RNA, 1961 nt, synthetic construct
  misc_feature 1..1961: note = mRNA product Design d-2 comprising derived and/or modified sequence from HRSV(A2)__F_DSCav1_mut0 (opt4)
  source 1..1961: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3992 - RNA, 1961 nt, synthetic construct
  misc_feature 1..1961: note = mRNA product Design d-2 comprising derived and/or modified sequence from HRSV(A2)__F_DSCav1_mut0 (opt5)
  source 1..1961: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3993 - RNA, 1961 nt, synthetic construct
  misc_feature 1..1961: note = mRNA product Design d-2 comprising derived and/or modified sequence from HRSV(A2)__F_DSCav1_mut0 (opt6)
  source 1..1961: mol_type = other RNA
gggagagcggctcggccattttgtcccagtcagtccggaggctgcggctgcagaagtaccgcctgcggagtaactgcaaagaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3994 - RNA, 1961 nt, synthetic construct
  misc_feature 1..1961: note = mRNA product Design d-2 comprising derived and/or modified sequence from HRSV(A2)__F_DSCav1_mut0 (opt11)
  source 1..1961: mol_type = other RNA
gggagagcggctcggccattttgtcccagtcagtccggaggctgcggctgcagaagtaccgcctgcggagtaactgcaaagaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3995 - RNA, 2277 nt, synthetic construct
  misc_feature 1..2277: note = mRNA product Design d-3 comprising derived and/or modified sequence from HRSV(A2)__F_DSCav1_mut0 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3996 - RNA, 2277 nt, synthetic construct
  misc_feature 1..2277: note = mRNA product Design d-3 comprising derived and/or modified sequence from HRSV(A2)__F_DSCav1_mut0 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3997 - RNA, 2277 nt, synthetic construct
  misc_feature 1..2277: note = mRNA product Design d-3 comprising derived and/or modified sequence from HRSV(A2)__F_DSCav1_mut0 (opt2)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3998 - RNA, 2277 nt, synthetic construct
  misc_feature 1..2277: note = mRNA product Design d-3 comprising derived and/or modified sequence from HRSV(A2)__F_DSCav1_mut0 (opt3)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3999 - RNA, 2277 nt, synthetic construct
  misc_feature 1..2277: note = mRNA product Design d-3 comprising derived and/or modified sequence from HRSV(A2)__F_DSCav1_mut0 (opt4)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4000 - RNA, 2277 nt, synthetic construct
  misc_feature 1..2277: note = mRNA product Design d-3 comprising derived and/or modified sequence from HRSV(A2)__F_DSCav1_mut0 (opt5)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4001 - RNA, 2277 nt, synthetic construct
  misc_feature 1..2277: note = mRNA product Design d-3 comprising derived and/or modified sequence from HRSV(A2)__F_DSCav1_mut0 (opt6)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4002 - RNA, 2277 nt, synthetic construct
  misc_feature 1..2277: note = mRNA product Design d-3 comprising derived and/or modified sequence from HRSV(A2)__F_DSCav1_mut0 (opt11)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4003 - RNA, 1960 nt, synthetic construct
  misc_feature 1..1960: note = mRNA product Design d-4 comprising derived and/or modified sequence from HRSV(A2)__F_DSCav1_mut0 (opt1)
  source 1..1960: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4004 - RNA, 1960 nt, synthetic construct
  misc_feature 1..1960: note = mRNA product Design d-4 comprising derived and/or modified sequence from HRSV(A2)__F_DSCav1_mut0 (opt1)
  source 1..1960: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4005 - RNA, 1960 nt, synthetic construct
  misc_feature 1..1960: note = mRNA product Design d-4 comprising derived and/or modified sequence from HRSV(A2)__F_DSCav1_mut0 (opt2)
  source 1..1960: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4006 - RNA, 1960 nt, synthetic construct
  misc_feature 1..1960: note = mRNA product Design d-4 comprising derived and/or modified sequence from HRSV(A2)__F_DSCav1_mut0 (opt3)
  source 1..1960: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4007 - RNA, 1960 nt, synthetic construct
  misc_feature 1..1960: note = mRNA product Design d-4 comprising derived and/or modified sequence from HRSV(A2)__F_DSCav1_mut0 (opt4)
  source 1..1960: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4008 - RNA, 1960 nt, synthetic construct
  misc_feature 1..1960: note = mRNA product Design d-4 comprising derived and/or modified sequence from HRSV(A2)__F_DSCav1_mut0 (opt5)
  source 1..1960: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4009 - RNA, 1960 nt, synthetic construct
  misc_feature 1..1960: note = mRNA product Design d-4 comprising derived and/or modified sequence from HRSV(A2)__F_DSCav1_mut0 (opt6)
  source 1..1960: mol_type = other RNA
gggagagtcccgcagtcggcgtccagcggctctgcttgttcgtgtgtgtgtcgttgcaggccttattcaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4010 - RNA, 1960 nt, synthetic construct
  misc_feature 1..1960: note = mRNA product Design d-4 comprising derived and/or modified sequence from HRSV(A2)__F_DSCav1_mut0 (opt11)
  source 1..1960: mol_type = other RNA
gggagagtcccgcagtcggcgtccagcggctctgcttgttcgtgtgtgtgtcgttgcaggccttattcaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4011 - RNA, 2057 nt, synthetic construct
  misc_feature 1..2057: note = mRNA product Design d-5 comprising derived and/or modified sequence from HRSV(A2)__F_DSCav1_mut0 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4012 - RNA, 2057 nt, synthetic construct
  misc_feature 1..2057: note = mRNA product Design d-5 comprising derived and/or modified sequence from HRSV(A2)__F_DSCav1_mut0 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4013 - RNA, 2057 nt, synthetic construct
  misc_feature 1..2057: note = mRNA product Design d-5 comprising derived and/or modified sequence from HRSV(A2)__F_DSCav1_mut0 (opt2)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4014 - RNA, 2057 nt, synthetic construct
  misc_feature 1..2057: note = mRNA product Design d-5 comprising derived and/or modified sequence from HRSV(A2)__F_DSCav1_mut0 (opt3)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4015 - RNA, 2057 nt, synthetic construct
  misc_feature 1..2057: note = mRNA product Design d-5 comprising derived and/or modified sequence from HRSV(A2)__F_DSCav1_mut0 (opt4)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4016 - RNA, 2057 nt, synthetic construct
  misc_feature 1..2057: note = mRNA product Design d-5 comprising derived and/or modified sequence from HRSV(A2)__F_DSCav1_mut0 (opt5)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4017 - RNA, 2057 nt, synthetic construct
  misc_feature 1..2057: note = mRNA product Design d-5 comprising derived and/or modified sequence from HRSV(A2)__F_DSCav1_mut0 (opt6)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4018 - RNA, 2057 nt, synthetic construct
  misc_feature 1..2057: note = mRNA product Design d-5 comprising derived and/or modified sequence from HRSV(A2)__F_DSCav1_mut0 (opt11)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4019 - RNA, 1937 nt, synthetic construct
  misc_feature 1..1937: note = mRNA product Design e-1 comprising derived and/or modified sequence from HRSV(A2)__F_DSCav1_mut0 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4020 - RNA, 1937 nt, synthetic construct
  misc_feature 1..1937: note = mRNA product Design e-1 comprising derived and/or modified sequence from HRSV(A2)__F_DSCav1_mut0 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4021 - RNA, 1937 nt, synthetic construct
  misc_feature 1..1937: note = mRNA product Design e-1 comprising derived and/or modified sequence from HRSV(A2)__F_DSCav1_mut0 (opt2)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4022 - RNA, 1937 nt, synthetic construct
  misc_feature 1..1937: note = mRNA product Design e-1 comprising derived and/or modified sequence from HRSV(A2)__F_DSCav1_mut0 (opt3)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4023 - RNA, 1937 nt, synthetic construct
  misc_feature 1..1937: note = mRNA product Design e-1 comprising derived and/or modified sequence from HRSV(A2)__F_DSCav1_mut0 (opt4)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4024 - RNA, 1937 nt, synthetic construct
  misc_feature 1..1937: note = mRNA product Design e-1 comprising derived and/or modified sequence from HRSV(A2)__F_DSCav1_mut0 (opt5)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4025 - RNA, 1937 nt, synthetic construct
  misc_feature 1..1937: note = mRNA product Design e-1 comprising derived and/or modified sequence from HRSV(A2)__F_DSCav1_mut0 (opt6)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4026 - RNA, 1937 nt, synthetic construct
  misc_feature 1..1937: note = mRNA product Design e-1 comprising derived and/or modified sequence from HRSV(A2)__F_DSCav1_mut0 (opt11)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4027 - RNA, 1919 nt, synthetic construct
  misc_feature 1..1919: note = mRNA product Design e-2 comprising derived and/or modified sequence from HRSV(A2)__F_DSCav1_mut0 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4028 - RNA, 1919 nt, synthetic construct
  misc_feature 1..1919: note = mRNA product Design e-2 comprising derived and/or modified sequence from HRSV(A2)__F_DSCav1_mut0 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4029 - RNA, 1919 nt, synthetic construct
  misc_feature 1..1919: note = mRNA product Design e-2 comprising derived and/or modified sequence from HRSV(A2)__F_DSCav1_mut0 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4030 - RNA, 1919 nt, synthetic construct
  misc_feature 1..1919: note = mRNA product Design e-2 comprising derived and/or modified sequence from HRSV(A2)__F_DSCav1_mut0 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4031 - RNA, 1919 nt, synthetic construct
  misc_feature 1..1919: note = mRNA product Design e-2 comprising derived and/or modified sequence from HRSV(A2)__F_DSCav1_mut0 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4032 - RNA, 1919 nt, synthetic construct
  misc_feature 1..1919: note = mRNA product Design e-2 comprising derived and/or modified sequence from HRSV(A2)__F_DSCav1_mut0 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4033 - RNA, 1919 nt, synthetic construct
  misc_feature 1..1919: note = mRNA product Design e-2 comprising derived and/or modified sequence from HRSV(A2)__F_DSCav1_mut0 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4034 - RNA, 1919 nt, synthetic construct
  misc_feature 1..1919: note = mRNA product Design e-2 comprising derived and/or modified sequence from HRSV(A2)__F_DSCav1_mut0 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4035 - RNA, 1889 nt, synthetic construct
  misc_feature 1..1889: note = mRNA product Design e-3 comprising derived and/or modified sequence from HRSV(A2)__F_DSCav1_mut0 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4036 - RNA, 1889 nt, synthetic construct
  misc_feature 1..1889: note = mRNA product Design e-3 comprising derived and/or modified sequence from HRSV(A2)__F_DSCav1_mut0 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4037 - RNA, 1889 nt, synthetic construct
  misc_feature 1..1889: note = mRNA product Design e-3 comprising derived and/or modified sequence from HRSV(A2)__F_DSCav1_mut0 (opt2)
  source 1..1889: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4038 - RNA, 1889 nt, synthetic construct
  misc_feature 1..1889: note = mRNA product Design e-3 comprising derived and/or modified sequence from HRSV(A2)__F_DSCav1_mut0 (opt3)
  source 1..1889: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4039 - RNA, 1889 nt, synthetic construct
  misc_feature 1..1889: note = mRNA product Design e-3 comprising derived and/or modified sequence from HRSV(A2)__F_DSCav1_mut0 (opt4)
  source 1..1889: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4040 - RNA, 1889 nt, synthetic construct
  misc_feature 1..1889: note = mRNA product Design e-3 comprising derived and/or modified sequence from HRSV(A2)__F_DSCav1_mut0 (opt5)
  source 1..1889: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4041 - RNA, 1889 nt, synthetic construct
  misc_feature 1..1889: note = mRNA product Design e-3 comprising derived and/or modified sequence from HRSV(A2)__F_DSCav1_mut0 (opt6)
  source 1..1889: mol_type = other RNA
gggagactttcccattctgtagcagaatttggtgttgcctgtggtcttggtcccgcggagaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4042 - RNA, 1889 nt, synthetic construct
  misc_feature 1..1889: note = mRNA product Design e-3 comprising derived and/or modified sequence from HRSV(A2)__F_DSCav1_mut0 (opt11)
  source 1..1889: mol_type = other RNA
gggagactttcccattctgtagcagaatttggtgttgcctgtggtcttggtcccgcggagaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4043 - RNA, 1943 nt, synthetic construct
  misc_feature 1..1943: note = mRNA product Design e-4 comprising derived and/or modified sequence from HRSV(A2)__F_DSCav1_mut0 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4044 - RNA, 1943 nt, synthetic construct
  misc_feature 1..1943: note = mRNA product Design e-4 comprising derived and/or modified sequence from HRSV(A2)__F_DSCav1_mut0 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4045 - RNA, 1943 nt, synthetic construct
  misc_feature 1..1943: note = mRNA product Design e-4 comprising derived and/or modified sequence from HRSV(A2)__F_DSCav1_mut0 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4046 - RNA, 1943 nt, synthetic construct
  misc_feature 1..1943: note = mRNA product Design e-4 comprising derived and/or modified sequence from HRSV(A2)__F_DSCav1_mut0 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4047 - RNA, 1943 nt, synthetic construct
  misc_feature 1..1943: note = mRNA product Design e-4 comprising derived and/or modified sequence from HRSV(A2)__F_DSCav1_mut0 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4048 - RNA, 1943 nt, synthetic construct
  misc_feature 1..1943: note = mRNA product Design e-4 comprising derived and/or modified sequence from HRSV(A2)__F_DSCav1_mut0 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4049 - RNA, 1943 nt, synthetic construct
  misc_feature 1..1943: note = mRNA product Design e-4 comprising derived and/or modified sequence from HRSV(A2)__F_DSCav1_mut0 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4050 - RNA, 1943 nt, synthetic construct
  misc_feature 1..1943: note = mRNA product Design e-4 comprising derived and/or modified sequence from HRSV(A2)__F_DSCav1_mut0 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4051 - RNA, 1910 nt, synthetic construct
  misc_feature 1..1910: note = mRNA product Design e-5 comprising derived and/or modified sequence from HRSV(A2)__F_DSCav1_mut0 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4052 - RNA, 1910 nt, synthetic construct
  misc_feature 1..1910: note = mRNA product Design e-5 comprising derived and/or modified sequence from HRSV(A2)__F_DSCav1_mut0 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4053 - RNA, 1910 nt, synthetic construct
  misc_feature 1..1910: note = mRNA product Design e-5 comprising derived and/or modified sequence from HRSV(A2)__F_DSCav1_mut0 (opt2)
  source 1..1910: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4054 - RNA, 1910 nt, synthetic construct
  misc_feature 1..1910: note = mRNA product Design e-5 comprising derived and/or modified sequence from HRSV(A2)__F_DSCav1_mut0 (opt3)
  source 1..1910: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4055 - RNA, 1910 nt, synthetic construct
  misc_feature 1..1910: note = mRNA product Design e-5 comprising derived and/or modified sequence from HRSV(A2)__F_DSCav1_mut0 (opt4)
  source 1..1910: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4056 - RNA, 1910 nt, synthetic construct
  misc_feature 1..1910: note = mRNA product Design e-5 comprising derived and/or modified sequence from HRSV(A2)__F_DSCav1_mut0 (opt5)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4057 - RNA, 1910 nt, synthetic construct
  misc_feature 1..1910: note = mRNA product Design e-5 comprising derived and/or modified sequence from HRSV(A2)__F_DSCav1_mut0 (opt6)
  source 1..1910: mol_type = other RNA
gggagagcggctcggccattttgtcccagtcagtccggaggctgcggctgcagaagtaccgcctgcggagtaactgcaaagaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4058 - RNA, 1910 nt, synthetic construct
  misc_feature 1..1910: note = mRNA product Design e-5 comprising derived and/or modified sequence from HRSV(A2)__F_DSCav1_mut0 (opt11)
  source 1..1910: mol_type = other RNA
gggagagcggctcggccattttgtcccagtcagtccggaggctgcggctgcagaagtaccgcctgcggagtaactgcaaagaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4059 - RNA, 1977 nt, synthetic construct
  misc_feature 1..1977: note = mRNA product Design e-6 comprising derived and/or modified sequence from HRSV(A2)__F_DSCav1_mut0 (opt1)
  source 1..1977: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4060 - RNA, 1977 nt, synthetic construct
  misc_feature 1..1977: note = mRNA product Design e-6 comprising derived and/or modified sequence from HRSV(A2)__F_DSCav1_mut0 (opt1)
  source 1..1977: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4061 - RNA, 1977 nt, synthetic construct
  misc_feature 1..1977: note = mRNA product Design e-6 comprising derived and/or modified sequence from HRSV(A2)__F_DSCav1_mut0 (opt2)
  source 1..1977: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4062 - RNA, 1977 nt, synthetic construct
  misc_feature 1..1977: note = mRNA product Design e-6 comprising derived and/or modified sequence from HRSV(A2)__F_DSCav1_mut0 (opt3)
  source 1..1977: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4063 - RNA, 1977 nt, synthetic construct
  misc_feature 1..1977: note = mRNA product Design e-6 comprising derived and/or modified sequence from HRSV(A2)__F_DSCav1_mut0 (opt4)
  source 1..1977: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4064 - RNA, 1977 nt, synthetic construct
  misc_feature 1..1977: note = mRNA product Design e-6 comprising derived and/or modified sequence from HRSV(A2)__F_DSCav1_mut0 (opt5)
  source 1..1977: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4065 - RNA, 1977 nt, synthetic construct
  misc_feature 1..1977: note = mRNA product Design e-6 comprising derived and/or modified sequence from HRSV(A2)__F_DSCav1_mut0 (opt6)
  source 1..1977: mol_type = other RNA
gggagagcggctcggccattttgtcccagtcagtccggaggctgcggctgcagaagtaccgcctgcggagtaactgcaaagaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4066 - RNA, 1977 nt, synthetic construct
  misc_feature 1..1977: note = mRNA product Design e-6 comprising derived and/or modified sequence from HRSV(A2)__F_DSCav1_mut0 (opt11)
  source 1..1977: mol_type = other RNA
gggagagcggctcggccattttgtcccagtcagtccggaggctgcggctgcagaagtaccgcctgcggagtaactgcaaagaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4067 - RNA, 2193 nt, synthetic construct
  misc_feature 1..2193: note = mRNA product Design f-1 comprising derived and/or modified sequence from HRSV(A2)__F_DSCav1_mut0 (opt1)
  source 1..2193: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4068 - RNA, 2193 nt, synthetic construct
  misc_feature 1..2193: note = mRNA product Design f-1 comprising derived and/or modified sequence from HRSV(A2)__F_DSCav1_mut0 (opt1)
  source 1..2193: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4069 - RNA, 2193 nt, synthetic construct
  misc_feature 1..2193: note = mRNA product Design f-1 comprising derived and/or modified sequence from HRSV(A2)__F_DSCav1_mut0 (opt2)
  source 1..2193: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4070 - RNA, 2193 nt, synthetic construct
  misc_feature 1..2193: note = mRNA product Design f-1 comprising derived and/or modified sequence from HRSV(A2)__F_DSCav1_mut0 (opt3)
  source 1..2193: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4071 - RNA, 2193 nt, synthetic construct
  misc_feature 1..2193: note = mRNA product Design f-1 comprising derived and/or modified sequence from HRSV(A2)__F_DSCav1_mut0 (opt4)
  source 1..2193: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4072 - RNA, 2193 nt, synthetic construct
  misc_feature 1..2193: note = mRNA product Design f-1 comprising derived and/or modified sequence from HRSV(A2)__F_DSCav1_mut0 (opt5)
  source 1..2193: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4073 - RNA, 2193 nt, synthetic construct
  misc_feature 1..2193: note = mRNA product Design f-1 comprising derived and/or modified sequence from HRSV(A2)__F_DSCav1_mut0 (opt6)
  source 1..2193: mol_type = other RNA
gggagagcggctcggccattttgtcccagtcagtccggaggctgcggctgcagaagtaccgcctgcggagtaactgcaaagaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4074 - RNA, 2193 nt, synthetic construct
  misc_feature 1..2193: note = mRNA product Design f-1 comprising derived and/or modified sequence from HRSV(A2)__F_DSCav1_mut0 (opt11)
  source 1..2193: mol_type = other RNA
gggagagcggctcggccattttgtcccagtcagtccggaggctgcggctgcagaagtaccgcctgcggagtaactgcaaagaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4075 - RNA, 1973 nt, synthetic construct
  misc_feature 1..1973: note = mRNA product Design f-2 comprising derived and/or modified sequence from HRSV(A2)__F_DSCav1_mut0 (opt1)
  source 1..1973: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4076 - RNA, 1973 nt, synthetic construct
  misc_feature 1..1973: note = mRNA product Design f-2 comprising derived and/or modified sequence from HRSV(A2)__F_DSCav1_mut0 (opt1)
  source 1..1973: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4077 - RNA, 1973 nt, synthetic construct
  misc_feature 1..1973: note = mRNA product Design f-2 comprising derived and/or modified sequence from HRSV(A2)__F_DSCav1_mut0 (opt2)
  source 1..1973: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4078 - RNA, 1973 nt, synthetic construct
  misc_feature 1..1973: note = mRNA product Design f-2 comprising derived and/or modified sequence from HRSV(A2)__F_DSCav1_mut0 (opt3)
  source 1..1973: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4079 - RNA, 1973 nt, synthetic construct
  misc_feature 1..1973: note = mRNA product Design f-2 comprising derived and/or modified sequence from HRSV(A2)__F_DSCav1_mut0 (opt4)
  source 1..1973: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4080 - RNA, 1973 nt, synthetic construct
  misc_feature 1..1973: note = mRNA product Design f-2 comprising derived and/or modified sequence from HRSV(A2)__F_DSCav1_mut0 (opt5)
  source 1..1973: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4081 - RNA, 1973 nt, synthetic construct
  misc_feature 1..1973: note = mRNA product Design f-2 comprising derived and/or modified sequence from HRSV(A2)__F_DSCav1_mut0 (opt6)
  source 1..1973: mol_type = other RNA
gggagagcggctcggccattttgtcccagtcagtccggaggctgcggctgcagaagtaccgcctgcggagtaactgcaaagaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4082 - RNA, 1973 nt, synthetic construct
  misc_feature 1..1973: note = mRNA product Design f-2 comprising derived and/or modified sequence from HRSV(A2)__F_DSCav1_mut0 (opt11)
  source 1..1973: mol_type = other RNA
gggagagcggctcggccattttgtcccagtcagtccggaggctgcggctgcagaagtaccgcctgcggagtaactgcaaagaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4083 - RNA, 1964 nt, synthetic construct
  misc_feature 1..1964: note = mRNA product Design f-3 comprising derived and/or modified sequence from HRSV(A2)__F_DSCav1_mut0 (opt1)
  source 1..1964: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4084 - RNA, 1964 nt, synthetic construct
  misc_feature 1..1964: note = mRNA product Design f-3 comprising derived and/or modified sequence from HRSV(A2)__F_DSCav1_mut0 (opt1)
  source 1..1964: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4085 - RNA, 1964 nt, synthetic construct
  misc_feature 1..1964: note = mRNA product Design f-3 comprising derived and/or modified sequence from HRSV(A2)__F_DSCav1_mut0 (opt2)
  source 1..1964: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4086 - RNA, 1964 nt, synthetic construct
  misc_feature 1..1964: note = mRNA product Design f-3 comprising derived and/or modified sequence from HRSV(A2)__F_DSCav1_mut0 (opt3)
  source 1..1964: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4087 - RNA, 1964 nt, synthetic construct
  misc_feature 1..1964: note = mRNA product Design f-3 comprising derived and/or modified sequence from HRSV(A2)__F_DSCav1_mut0 (opt4)
  source 1..1964: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4088 - RNA, 1964 nt, synthetic construct
  misc_feature 1..1964: note = mRNA product Design f-3 comprising derived and/or modified sequence from HRSV(A2)__F_DSCav1_mut0 (opt5)
  source 1..1964: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4089 - RNA, 1964 nt, synthetic construct
  misc_feature 1..1964: note = mRNA product Design f-3 comprising derived and/or modified sequence from HRSV(A2)__F_DSCav1_mut0 (opt6)
  source 1..1964: mol_type = other RNA
gggagagtcccgcagtcggcgtccagcggctctgcttgttcgtgtgtgtgtcgttgcaggccttattcaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4090 - RNA, 1964 nt, synthetic construct
  misc_feature 1..1964: note = mRNA product Design f-3 comprising derived and/or modified sequence from HRSV(A2)__F_DSCav1_mut0 (opt11)
  source 1..1964: mol_type = other RNA
gggagagtcccgcagtcggcgtccagcggctctgcttgttcgtgtgtgtgtcgttgcaggccttattcaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4091 - RNA, 2180 nt, synthetic construct
  misc_feature 1..2180: note = mRNA product Design f-4 comprising derived and/or modified sequence from HRSV(A2)__F_DSCav1_mut0 (opt1)
  source 1..2180: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4092 - RNA, 2180 nt, synthetic construct
  misc_feature 1..2180: note = mRNA product Design f-4 comprising derived and/or modified sequence from HRSV(A2)__F_DSCav1_mut0 (opt1)
  source 1..2180: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4093 - RNA, 2180 nt, synthetic construct
  misc_feature 1..2180: note = mRNA product Design f-4 comprising derived and/or modified sequence from HRSV(A2)__F_DSCav1_mut0 (opt2)
  source 1..2180: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4094 - RNA, 2180 nt, synthetic construct
  misc_feature 1..2180: note = mRNA product Design f-4 comprising derived and/or modified sequence from HRSV(A2)__F_DSCav1_mut0 (opt3)
  source 1..2180: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4095 - RNA, 2180 nt, synthetic construct
  misc_feature 1..2180: note = mRNA product Design f-4 comprising derived and/or modified sequence from HRSV(A2)__F_DSCav1_mut0 (opt4)
  source 1..2180: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4096 - RNA, 2180 nt, synthetic construct
  misc_feature 1..2180: note = mRNA product Design f-4 comprising derived and/or modified sequence from HRSV(A2)__F_DSCav1_mut0 (opt5)
  source 1..2180: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4097 - RNA, 2180 nt, synthetic construct
  misc_feature 1..2180: note = mRNA product Design f-4 comprising derived and/or modified sequence from HRSV(A2)__F_DSCav1_mut0 (opt6)
  source 1..2180: mol_type = other RNA
gggagagtcccgcagtcggcgtccagcggctctgcttgttcgtgtgtgtgtcgttgcaggccttattcaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4098 - RNA, 2180 nt, synthetic construct
  misc_feature 1..2180: note = mRNA product Design f-4 comprising derived and/or modified sequence from HRSV(A2)__F_DSCav1_mut0 (opt11)
  source 1..2180: mol_type = other RNA
gggagagtcccgcagtcggcgtccagcggctctgcttgttcgtgtgtgtgtcgttgcaggccttattcaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4099 - RNA, 1956 nt, synthetic construct
  misc_feature 1..1956: note = mRNA product Design f-5 comprising derived and/or modified sequence from HRSV(A2)__F_DSCav1_mut0 (opt1)
  source 1..1956: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4100 - RNA, 1956 nt, synthetic construct
  misc_feature 1..1956: note = mRNA product Design f-5 comprising derived and/or modified sequence from HRSV(A2)__F_DSCav1_mut0 (opt1)
  source 1..1956: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4101 - RNA, 1956 nt, synthetic construct
  misc_feature 1..1956: note = mRNA product Design f-5 comprising derived and/or modified sequence from HRSV(A2)__F_DSCav1_mut0 (opt2)
  source 1..1956: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4102 - RNA, 1956 nt, synthetic construct
  misc_feature 1..1956: note = mRNA product Design f-5 comprising derived and/or modified sequence from HRSV(A2)__F_DSCav1_mut0 (opt3)
  source 1..1956: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4103 - RNA, 1956 nt, synthetic construct
  misc_feature 1..1956: note = mRNA product Design f-5 comprising derived and/or modified sequence from HRSV(A2)__F_DSCav1_mut0 (opt4)
  source 1..1956: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4104 - RNA, 1956 nt, synthetic construct
  misc_feature 1..1956: note = mRNA product Design f-5 comprising derived and/or modified sequence from HRSV(A2)__F_DSCav1_mut0 (opt5)
  source 1..1956: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4105 - RNA, 1956 nt, synthetic construct
  misc_feature 1..1956: note = mRNA product Design f-5 comprising derived and/or modified sequence from HRSV(A2)__F_DSCav1_mut0 (opt6)
  source 1..1956: mol_type = other RNA
gggagactttcccattctgtagcagaatttggtgttgcctgtggtcttggtcccgcggagaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4106 - RNA, 1956 nt, synthetic construct
  misc_feature 1..1956: note = mRNA product Design f-5 comprising derived and/or modified sequence from HRSV(A2)__F_DSCav1_mut0 (opt11)
  source 1..1956: mol_type = other RNA
gggagactttcccattctgtagcagaatttggtgttgcctgtggtcttggtcccgcggagaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4107 - RNA, 1952 nt, synthetic construct
  misc_feature 1..1952: note = mRNA product Design g-1 comprising derived and/or modified sequence from HRSV(A2)__F_DSCav1_mut0 (opt1)
  source 1..1952: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4108 - RNA, 1952 nt, synthetic construct
  misc_feature 1..1952: note = mRNA product Design g-1 comprising derived and/or modified sequence from HRSV(A2)__F_DSCav1_mut0 (opt1)
  source 1..1952: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4109 - RNA, 1952 nt, synthetic construct
  misc_feature 1..1952: note = mRNA product Design g-1 comprising derived and/or modified sequence from HRSV(A2)__F_DSCav1_mut0 (opt2)
  source 1..1952: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4110 - RNA, 1952 nt, synthetic construct
  misc_feature 1..1952: note = mRNA product Design g-1 comprising derived and/or modified sequence from HRSV(A2)__F_DSCav1_mut0 (opt3)
  source 1..1952: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4111 - RNA, 1952 nt, synthetic construct
  misc_feature 1..1952: note = mRNA product Design g-1 comprising derived and/or modified sequence from HRSV(A2)__F_DSCav1_mut0 (opt4)
  source 1..1952: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4112 - RNA, 1952 nt, synthetic construct
  misc_feature 1..1952: note = mRNA product Design g-1 comprising derived and/or modified sequence from HRSV(A2)__F_DSCav1_mut0 (opt5)
  source 1..1952: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4113 - RNA, 1952 nt, synthetic construct
  misc_feature 1..1952: note = mRNA product Design g-1 comprising derived and/or modified sequence from HRSV(A2)__F_DSCav1_mut0 (opt6)
  source 1..1952: mol_type = other RNA
gggagactttcccattctgtagcagaatttggtgttgcctgtggtcttggtcccgcggagaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4114 - RNA, 1952 nt, synthetic construct
  misc_feature 1..1952: note = mRNA product Design g-1 comprising derived and/or modified sequence from HRSV(A2)__F_DSCav1_mut0 (opt11)
  source 1..1952: mol_type = other RNA
gggagactttcccattctgtagcagaatttggtgttgcctgtggtcttggtcccgcggagaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4115 - RNA, 1967 nt, synthetic construct
  misc_feature 1..1967: note = mRNA product Design g-2 comprising derived and/or modified sequence from HRSV(A2)__F_DSCav1_mut0 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4116 - RNA, 1967 nt, synthetic construct
  misc_feature 1..1967: note = mRNA product Design g-2 comprising derived and/or modified sequence from HRSV(A2)__F_DSCav1_mut0 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4117 - RNA, 1967 nt, synthetic construct
  misc_feature 1..1967: note = mRNA product Design g-2 comprising derived and/or modified sequence from HRSV(A2)__F_DSCav1_mut0 (opt2)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4118 - RNA, 1967 nt, synthetic construct
  misc_feature 1..1967: note = mRNA product Design g-2 comprising derived and/or modified sequence from HRSV(A2)__F_DSCav1_mut0 (opt3)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4119 - RNA, 1967 nt, synthetic construct
  misc_feature 1..1967: note = mRNA product Design g-2 comprising derived and/or modified sequence from HRSV(A2)__F_DSCav1_mut0 (opt4)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4120 - RNA, 1967 nt, synthetic construct
  misc_feature 1..1967: note = mRNA product Design g-2 comprising derived and/or modified sequence from HRSV(A2)__F_DSCav1_mut0 (opt5)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4121 - RNA, 1967 nt, synthetic construct
  misc_feature 1..1967: note = mRNA product Design g-2 comprising derived and/or modified sequence from HRSV(A2)__F_DSCav1_mut0 (opt6)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4122 - RNA, 1967 nt, synthetic construct
  misc_feature 1..1967: note = mRNA product Design g-2 comprising derived and/or modified sequence from HRSV(A2)__F_DSCav1_mut0 (opt11)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4123 - RNA, 2199 nt, synthetic construct
  misc_feature 1..2199: note = mRNA product Design g-3 comprising derived and/or modified sequence from HRSV(A2)__F_DSCav1_mut0 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4124 - RNA, 2199 nt, synthetic construct
  misc_feature 1..2199: note = mRNA product Design g-3 comprising derived and/or modified sequence from HRSV(A2)__F_DSCav1_mut0 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4125 - RNA, 2199 nt, synthetic construct
  misc_feature 1..2199: note = mRNA product Design g-3 comprising derived and/or modified sequence from HRSV(A2)__F_DSCav1_mut0 (opt2)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4126 - RNA, 2199 nt, synthetic construct
  misc_feature 1..2199: note = mRNA product Design g-3 comprising derived and/or modified sequence from HRSV(A2)__F_DSCav1_mut0 (opt3)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4127 - RNA, 2199 nt, synthetic construct
  misc_feature 1..2199: note = mRNA product Design g-3 comprising derived and/or modified sequence from HRSV(A2)__F_DSCav1_mut0 (opt4)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4128 - RNA, 2199 nt, synthetic construct
  misc_feature 1..2199: note = mRNA product Design g-3 comprising derived and/or modified sequence from HRSV(A2)__F_DSCav1_mut0 (opt5)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4129 - RNA, 2199 nt, synthetic construct
  misc_feature 1..2199: note = mRNA product Design g-3 comprising derived and/or modified sequence from HRSV(A2)__F_DSCav1_mut0 (opt6)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4130 - RNA, 2199 nt, synthetic construct
  misc_feature 1..2199: note = mRNA product Design g-3 comprising derived and/or modified sequence from HRSV(A2)__F_DSCav1_mut0 (opt11)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4131 - RNA, 1994 nt, synthetic construct
  misc_feature 1..1994: note = mRNA product Design g-4 comprising derived and/or modified sequence from HRSV(A2)__F_DSCav1_mut0 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4132 - RNA, 1994 nt, synthetic construct
  misc_feature 1..1994: note = mRNA product Design g-4 comprising derived and/or modified sequence from HRSV(A2)__F_DSCav1_mut0 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4133 - RNA, 1994 nt, synthetic construct
  misc_feature 1..1994: note = mRNA product Design g-4 comprising derived and/or modified sequence from HRSV(A2)__F_DSCav1_mut0 (opt2)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4134 - RNA, 1994 nt, synthetic construct
  misc_feature 1..1994: note = mRNA product Design g-4 comprising derived and/or modified sequence from HRSV(A2)__F_DSCav1_mut0 (opt3)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4135 - RNA, 1994 nt, synthetic construct
  misc_feature 1..1994: note = mRNA product Design g-4 comprising derived and/or modified sequence from HRSV(A2)__F_DSCav1_mut0 (opt4)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4136 - RNA, 1994 nt, synthetic construct
  misc_feature 1..1994: note = mRNA product Design g-4 comprising derived and/or modified sequence from HRSV(A2)__F_DSCav1_mut0 (opt5)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4137 - RNA, 1994 nt, synthetic construct
  misc_feature 1..1994: note = mRNA product Design g-4 comprising derived and/or modified sequence from HRSV(A2)__F_DSCav1_mut0 (opt6)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4138 - RNA, 1994 nt, synthetic construct
  misc_feature 1..1994: note = mRNA product Design g-4 comprising derived and/or modified sequence from HRSV(A2)__F_DSCav1_mut0 (opt11)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4139 - RNA, 1970 nt, synthetic construct
  misc_feature 1..1970: note = mRNA product Design g-5 comprising derived and/or modified sequence from HRSV(A2)__F_DSCav1_mut0 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4140 - RNA, 1970 nt, synthetic construct
  misc_feature 1..1970: note = mRNA product Design g-5 comprising derived and/or modified sequence from HRSV(A2)__F_DSCav1_mut0 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4141 - RNA, 1970 nt, synthetic construct
  misc_feature 1..1970: note = mRNA product Design g-5 comprising derived and/or modified sequence from HRSV(A2)__F_DSCav1_mut0 (opt2)
  source 1..1970: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4142 - RNA, 1970 nt, synthetic construct
  misc_feature 1..1970: note = mRNA product Design g-5 comprising derived and/or modified sequence from HRSV(A2)__F_DSCav1_mut0 (opt3)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4143 - RNA, 1970 nt, synthetic construct
  misc_feature 1..1970: note = mRNA product Design g-5 comprising derived and/or modified sequence from HRSV(A2)__F_DSCav1_mut0 (opt4)
  source 1..1970: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4144 - RNA, 1970 nt, synthetic construct
  misc_feature 1..1970: note = mRNA product Design g-5 comprising derived and/or modified sequence from HRSV(A2)__F_DSCav1_mut0 (opt5)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4145 - RNA, 1970 nt, synthetic construct
  misc_feature 1..1970: note = mRNA product Design g-5 comprising derived and/or modified sequence from HRSV(A2)__F_DSCav1_mut0 (opt6)
  source 1..1970: mol_type = other RNA
gggagacccgtgacccggaagttgtacggctacgcgactttccctcccacaaaccctcgcgcccttcctttcctacttgggcccggcagaaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4146 - RNA, 1970 nt, synthetic construct
  misc_feature 1..1970: note = mRNA product Design g-5 comprising derived and/or modified sequence from HRSV(A2)__F_DSCav1_mut0 (opt11)
  source 1..1970: mol_type = other RNA
gggagacccgtgacccggaagttgtacggctacgcgactttccctcccacaaaccctcgcgcccttcctttcctacttgggcccggcagaaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4147 - RNA, 1986 nt, synthetic construct
  misc_feature 1..1986: note = mRNA product Design h-1 comprising derived and/or modified sequence from HRSV(A2)__F_DSCav1_mut0 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4148 - RNA, 1986 nt, synthetic construct
  misc_feature 1..1986: note = mRNA product Design h-1 comprising derived and/or modified sequence from HRSV(A2)__F_DSCav1_mut0 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4149 - RNA, 1986 nt, synthetic construct
  misc_feature 1..1986: note = mRNA product Design h-1 comprising derived and/or modified sequence from HRSV(A2)__F_DSCav1_mut0 (opt2)
  source 1..1986: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4150 - RNA, 1986 nt, synthetic construct
  misc_feature 1..1986: note = mRNA product Design h-1 comprising derived and/or modified sequence from HRSV(A2)__F_DSCav1_mut0 (opt3)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4151 - RNA, 1986 nt, synthetic construct
  misc_feature 1..1986: note = mRNA product Design h-1 comprising derived and/or modified sequence from HRSV(A2)__F_DSCav1_mut0 (opt4)
  source 1..1986: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4152 - RNA, 1986 nt, synthetic construct
  misc_feature 1..1986: note = mRNA product Design h-1 comprising derived and/or modified sequence from HRSV(A2)__F_DSCav1_mut0 (opt5)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4153 - RNA, 1986 nt, synthetic construct
  misc_feature 1..1986: note = mRNA product Design h-1 comprising derived and/or modified sequence from HRSV(A2)__F_DSCav1_mut0 (opt6)
  source 1..1986: mol_type = other RNA
gggagacccgtgacccggaagttgtacggctacgcgactttccctcccacaaaccctcgcgcccttcctttcctacttgggcccggcagaaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4154 - RNA, 1986 nt, synthetic construct
  misc_feature 1..1986: note = mRNA product Design h-1 comprising derived and/or modified sequence from HRSV(A2)__F_DSCav1_mut0 (opt11)
  source 1..1986: mol_type = other RNA
gggagacccgtgacccggaagttgtacggctacgcgactttccctcccacaaaccctcgcgcccttcctttcctacttgggcccggcagaaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4155 - RNA, 2202 nt, synthetic construct
  misc_feature 1..2202: note = mRNA product Design h-2 comprising derived and/or modified sequence from HRSV(A2)__F_DSCav1_mut0 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4156 - RNA, 2202 nt, synthetic construct
  misc_feature 1..2202: note = mRNA product Design h-2 comprising derived and/or modified sequence from HRSV(A2)__F_DSCav1_mut0 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4157 - RNA, 2202 nt, synthetic construct
  misc_feature 1..2202: note = mRNA product Design h-2 comprising derived and/or modified sequence from HRSV(A2)__F_DSCav1_mut0 (opt2)
  source 1..2202: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4158 - RNA, 2202 nt, synthetic construct
  misc_feature 1..2202: note = mRNA product Design h-2 comprising derived and/or modified sequence from HRSV(A2)__F_DSCav1_mut0 (opt3)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4159 - RNA, 2202 nt, synthetic construct
  misc_feature 1..2202: note = mRNA product Design h-2 comprising derived and/or modified sequence from HRSV(A2)__F_DSCav1_mut0 (opt4)
  source 1..2202: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4160 - RNA, 2202 nt, synthetic construct
  misc_feature 1..2202: note = mRNA product Design h-2 comprising derived and/or modified sequence from HRSV(A2)__F_DSCav1_mut0 (opt5)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4161 - RNA, 2202 nt, synthetic construct
  misc_feature 1..2202: note = mRNA product Design h-2 comprising derived and/or modified sequence from HRSV(A2)__F_DSCav1_mut0 (opt6)
  source 1..2202: mol_type = other RNA
gggagacccgtgacccggaagttgtacggctacgcgactttccctcccacaaaccctcgcgcccttcctttcctacttgggcccggcagaaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4162 - RNA, 2202 nt, synthetic construct
  misc_feature 1..2202: note = mRNA product Design h-2 comprising derived and/or modified sequence from HRSV(A2)__F_DSCav1_mut0 (opt11)
  source 1..2202: mol_type = other RNA
gggagacccgtgacccggaagttgtacggctacgcgactttccctcccacaaaccctcgcgcccttcctttcctacttgggcccggcagaaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4163 - RNA, 1982 nt, synthetic construct
  misc_feature 1..1982: note = mRNA product Design h-3 comprising derived and/or modified sequence from HRSV(A2)__F_DSCav1_mut0 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4164 - RNA, 1982 nt, synthetic construct
  misc_feature 1..1982: note = mRNA product Design h-3 comprising derived and/or modified sequence from HRSV(A2)__F_DSCav1_mut0 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4165 - RNA, 1982 nt, synthetic construct
  misc_feature 1..1982: note = mRNA product Design h-3 comprising derived and/or modified sequence from HRSV(A2)__F_DSCav1_mut0 (opt2)
  source 1..1982: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4166 - RNA, 1982 nt, synthetic construct
  misc_feature 1..1982: note = mRNA product Design h-3 comprising derived and/or modified sequence from HRSV(A2)__F_DSCav1_mut0 (opt3)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4167 - RNA, 1982 nt, synthetic construct
  misc_feature 1..1982: note = mRNA product Design h-3 comprising derived and/or modified sequence from HRSV(A2)__F_DSCav1_mut0 (opt4)
  source 1..1982: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4168 - RNA, 1982 nt, synthetic construct
  misc_feature 1..1982: note = mRNA product Design h-3 comprising derived and/or modified sequence from HRSV(A2)__F_DSCav1_mut0 (opt5)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4169 - RNA, 1982 nt, synthetic construct
  misc_feature 1..1982: note = mRNA product Design h-3 comprising derived and/or modified sequence from HRSV(A2)__F_DSCav1_mut0 (opt6)
  source 1..1982: mol_type = other RNA
gggagacccgtgacccggaagttgtacggctacgcgactttccctcccacaaaccctcgcgcccttcctttcctacttgggcccggcagaaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4170 - RNA, 1982 nt, synthetic construct
  misc_feature 1..1982: note = mRNA product Design h-3 comprising derived and/or modified sequence from HRSV(A2)__F_DSCav1_mut0 (opt11)
  source 1..1982: mol_type = other RNA
gggagacccgtgacccggaagttgtacggctacgcgactttccctcccacaaaccctcgcgcccttcctttcctacttgggcccggcagaaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4171 - RNA, 2045 nt, synthetic construct
  misc_feature 1..2045: note = mRNA product Design h-4 comprising derived and/or modified sequence from HRSV(A2)__F_DSCav1_mut0 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4172 - RNA, 2045 nt, synthetic construct
  misc_feature 1..2045: note = mRNA product Design h-4 comprising derived and/or modified sequence from HRSV(A2)__F_DSCav1_mut0 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4173 - RNA, 2045 nt, synthetic construct
  misc_feature 1..2045: note = mRNA product Design h-4 comprising derived and/or modified sequence from HRSV(A2)__F_DSCav1_mut0 (opt2)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4174 - RNA, 2045 nt, synthetic construct
  misc_feature 1..2045: note = mRNA product Design h-4 comprising derived and/or modified sequence from HRSV(A2)__F_DSCav1_mut0 (opt3)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4175 - RNA, 2045 nt, synthetic construct
  misc_feature 1..2045: note = mRNA product Design h-4 comprising derived and/or modified sequence from HRSV(A2)__F_DSCav1_mut0 (opt4)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4176 - RNA, 2045 nt, synthetic construct
  misc_feature 1..2045: note = mRNA product Design h-4 comprising derived and/or modified sequence from HRSV(A2)__F_DSCav1_mut0 (opt5)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4177 - RNA, 2045 nt, synthetic construct
  misc_feature 1..2045: note = mRNA product Design h-4 comprising derived and/or modified sequence from HRSV(A2)__F_DSCav1_mut0 (opt6)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4178 - RNA, 2045 nt, synthetic construct
  misc_feature 1..2045: note = mRNA product Design h-4 comprising derived and/or modified sequence from HRSV(A2)__F_DSCav1_mut0 (opt11)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4179 - RNA, 2061 nt, synthetic construct
  misc_feature 1..2061: note = mRNA product Design h-5 comprising derived and/or modified sequence from HRSV(A2)__F_DSCav1_mut0 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4180 - RNA, 2061 nt, synthetic construct
  misc_feature 1..2061: note = mRNA product Design h-5 comprising derived and/or modified sequence from HRSV(A2)__F_DSCav1_mut0 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4181 - RNA, 2061 nt, synthetic construct
  misc_feature 1..2061: note = mRNA product Design h-5 comprising derived and/or modified sequence from HRSV(A2)__F_DSCav1_mut0 (opt2)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4182 - RNA, 2061 nt, synthetic construct
  misc_feature 1..2061: note = mRNA product Design h-5 comprising derived and/or modified sequence from HRSV(A2)__F_DSCav1_mut0 (opt3)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4183 - RNA, 2061 nt, synthetic construct
  misc_feature 1..2061: note = mRNA product Design h-5 comprising derived and/or modified sequence from HRSV(A2)__F_DSCav1_mut0 (opt4)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4184 - RNA, 2061 nt, synthetic construct
  misc_feature 1..2061: note = mRNA product Design h-5 comprising derived and/or modified sequence from HRSV(A2)__F_DSCav1_mut0 (opt5)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4185 - RNA, 2061 nt, synthetic construct
  misc_feature 1..2061: note = mRNA product Design h-5 comprising derived and/or modified sequence from HRSV(A2)__F_DSCav1_mut0 (opt6)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4186 - RNA, 2061 nt, synthetic construct
  misc_feature 1..2061: note = mRNA product Design h-5 comprising derived and/or modified sequence from HRSV(A2)__F_DSCav1_mut0 (opt11)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4187 - RNA, 1994 nt, synthetic construct
  misc_feature 1..1994: note = mRNA product Design i-1 comprising derived and/or modified sequence from HRSV(A2)__F_DSCav1_mut0 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4188 - RNA, 1994 nt, synthetic construct
  misc_feature 1..1994: note = mRNA product Design i-1 comprising derived and/or modified sequence from HRSV(A2)__F_DSCav1_mut0 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4189 - RNA, 1994 nt, synthetic construct
  misc_feature 1..1994: note = mRNA product Design i-1 comprising derived and/or modified sequence from HRSV(A2)__F_DSCav1_mut0 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4190 - RNA, 1994 nt, synthetic construct
  misc_feature 1..1994: note = mRNA product Design i-1 comprising derived and/or modified sequence from HRSV(A2)__F_DSCav1_mut0 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4191 - RNA, 1994 nt, synthetic construct
  misc_feature 1..1994: note = mRNA product Design i-1 comprising derived and/or modified sequence from HRSV(A2)__F_DSCav1_mut0 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4192 - RNA, 1994 nt, synthetic construct
  misc_feature 1..1994: note = mRNA product Design i-1 comprising derived and/or modified sequence from HRSV(A2)__F_DSCav1_mut0 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4193 - RNA, 1994 nt, synthetic construct
  misc_feature 1..1994: note = mRNA product Design i-1 comprising derived and/or modified sequence from HRSV(A2)__F_DSCav1_mut0 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4194 - RNA, 1994 nt, synthetic construct
  misc_feature 1..1994: note = mRNA product Design i-1 comprising derived and/or modified sequence from HRSV(A2)__F_DSCav1_mut0 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4195 - RNA, 1994 nt, synthetic construct
  misc_feature 1..1994: note = mRNA product Design i-2 comprising derived and/or modified sequence from HRSV(A2)__F_DSCav1_mut0 (opt1)
  source 1..1994: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4196 - RNA, 1994 nt, synthetic construct
  misc_feature 1..1994: note = mRNA product Design i-2 comprising derived and/or modified sequence from HRSV(A2)__F_DSCav1_mut0 (opt1)
  source 1..1994: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4197 - RNA, 1994 nt, synthetic construct
  misc_feature 1..1994: note = mRNA product Design i-2 comprising derived and/or modified sequence from HRSV(A2)__F_DSCav1_mut0 (opt2)
  source 1..1994: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4198 - RNA, 1994 nt, synthetic construct
  misc_feature 1..1994: note = mRNA product Design i-2 comprising derived and/or modified sequence from HRSV(A2)__F_DSCav1_mut0 (opt3)
  source 1..1994: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4199 - RNA, 1994 nt, synthetic construct
  misc_feature 1..1994: note = mRNA product Design i-2 comprising derived and/or modified sequence from HRSV(A2)__F_DSCav1_mut0 (opt4)
  source 1..1994: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4200 - RNA, 1994 nt, synthetic construct
  misc_feature 1..1994: note = mRNA product Design i-2 comprising derived and/or modified sequence from HRSV(A2)__F_DSCav1_mut0 (opt5)
  source 1..1994: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4201 - RNA, 1994 nt, synthetic construct
  misc_feature 1..1994: note = mRNA product Design i-2 comprising derived and/or modified sequence from HRSV(A2)__F_DSCav1_mut0 (opt6)
  source 1..1994: mol_type = other RNA
gggagaggcgctgcctacggaggtggcagccatctccttctcggcatcaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4202 - RNA, 1994 nt, synthetic construct
  misc_feature 1..1994: note = mRNA product Design i-2 comprising derived and/or modified sequence from HRSV(A2)__F_DSCav1_mut0 (opt11)
  source 1..1994: mol_type = other RNA
gggagaggcgctgcctacggaggtggcagccatctccttctcggcatcaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4203 - RNA, 1990 nt, synthetic construct
  misc_feature 1..1990: note = mRNA product Design i-2 comprising derived and/or modified sequence from HRSV(A2)__F_DSCav1_mut0 (opt1)
  source 1..1990: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4204 - RNA, 1990 nt, synthetic construct
  misc_feature 1..1990: note = mRNA product Design i-2 comprising derived and/or modified sequence from HRSV(A2)__F_DSCav1_mut0 (opt1)
  source 1..1990: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4205 - RNA, 1990 nt, synthetic construct
  misc_feature 1..1990: note = mRNA product Design i-2 comprising derived and/or modified sequence from HRSV(A2)__F_DSCav1_mut0 (opt2)
  source 1..1990: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4206 - RNA, 1990 nt, synthetic construct
  misc_feature 1..1990: note = mRNA product Design i-2 comprising derived and/or modified sequence from HRSV(A2)__F_DSCav1_mut0 (opt3)
  source 1..1990: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4207 - RNA, 1990 nt, synthetic construct
  misc_feature 1..1990: note = mRNA product Design i-2 comprising derived and/or modified sequence from HRSV(A2)__F_DSCav1_mut0 (opt4)
  source 1..1990: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4208 - RNA, 1990 nt, synthetic construct
  misc_feature 1..1990: note = mRNA product Design i-2 comprising derived and/or modified sequence from HRSV(A2)__F_DSCav1_mut0 (opt5)
  source 1..1990: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4209 - RNA, 1990 nt, synthetic construct
  misc_feature 1..1990: note = mRNA product Design i-2 comprising derived and/or modified sequence from HRSV(A2)__F_DSCav1_mut0 (opt6)
  source 1..1990: mol_type = other RNA
ggggcgctgcctacggaggtggcagccatctccttctcggcatcaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4210 - RNA, 1990 nt, synthetic construct
  misc_feature 1..1990: note = mRNA product Design i-2 comprising derived and/or modified sequence from HRSV(A2)__F_DSCav1_mut0 (opt11)
  source 1..1990: mol_type = other RNA
ggggcgctgcctacggaggtggcagccatctccttctcggcatcaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4211 - RNA, 1825 nt, synthetic construct
  misc_feature 1..1825: note = mRNA product Design i-3 comprising derived and/or modified sequence from HRSV(A2)__F_DSCav1_mut0 (opt1) R7454
  source 1..1825: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4212 - RNA, 1825 nt, synthetic construct
  misc_feature 1..1825: note = mRNA product Design i-3 comprising derived and/or modified sequence from HRSV(A2)__F_DSCav1_mut0 (opt1)
  source 1..1825: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4213 - RNA, 1825 nt, synthetic construct
  misc_feature 1..1825: note = mRNA product Design i-3 comprising derived and/or modified sequence from HRSV(A2)__F_DSCav1_mut0 (opt2)
  source 1..1825: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4214 - RNA, 1825 nt, synthetic construct
  misc_feature 1..1825: note = mRNA product Design i-3 comprising derived and/or modified sequence from HRSV(A2)__F_DSCav1_mut0 (opt3)
  source 1..1825: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctctacaccggtgaccctgagcaaggaccagctctccggcataaacaatatcgctttctcaaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4215 - RNA, 1825 nt, synthetic construct
  misc_feature 1..1825: note = mRNA product Design i-3 comprising derived and/or modified sequence from HRSV(A2)__F_DSCav1_mut0 (opt4)
  source 1..1825: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4216 - RNA, 1825 nt, synthetic construct
  misc_feature 1..1825: note = mRNA product Design i-3 comprising derived and/or modified sequence from HRSV(A2)__F_DSCav1_mut0 (opt5)
  source 1..1825: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatccacacctgtgacccttagcaaggaccagctctctgggattaacaatatcgcgttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4217 - RNA, 1825 nt, synthetic construct
  misc_feature 1..1825: note = mRNA product Design i-3 comprising derived and/or modified sequence from HRSV(A2)__F_DSCav1_mut0 (opt6)
  source 1..1825: mol_type = other RNA
gggagaaagcttaccatggaactactaatactaaaagccaatgcaataacaaccatactaaccgccgtaacattttgtttcgcatcaggtcaaaacataaccgaagaattttatcaatcaacatgctcagcagtatcaaaaggatacttatccgctctaagaacaggatggtacacaagtgtaattacaatagagctctcaaacataaaagaaaacaaatgcaatggaactgacgcaaaagttaaacttataaaacaagaactagataaatataaaaatgcagtaaccgaattacaactcctaatgcaatccacacctgctaccggttccggatcagccatagcatctggagtagccgtatgcaaagtcctccacctagaaggagaagtaaataaaatcaaatcagcactattatctaccaataaagcagttgtctcactatccaatggcgtatcagtactaacattcaaagtattagaccttaaaaactacatagacaaacaactattaccaattctgaacaaacaatcctgttcaatatcaaacatcgaaacggtaatagaatttcaacaaaaaaataacagattacttgaaataacaagagaattttcagtaaatgcaggagttacaacacccgtctccacctacatgctcacaaattcagaattattatcacttataaacgacatgccaataactaacgaccaaaaaaaactaatgtcaaacaatgtccaaatagtccgacaacaatcctactcaataatgtgcattataaaagaagaagtcctagcctacgttgtccaactacccttatatggagtaatagataccccatgctggaaacttcatacctcccccctatgcacaacaaacacaaaagaaggctcaaacatctgcttaacacgtacagaccgaggttggtactgtgataacgcaggatccgtatcatttttcccacaagcagaaacatgcaaagtacaatcaaaccgcgttttttgtgacaccatgaacagcagaaccctcccttcagaagtaaacctatgcaacgtcgatatatttaacccaaaatacgattgcaaaataatgacatcaaaaaccgatgtctcatcttcagtaataacctctctaggagcaatagtctcatgttacggaaaaacaaaatgcacagcaagtaataaaaatagaggaataataaaaacattctctaatggctgcgactacgtatccaataaaggcgttgacacagtatccgtaggcaacacactctactatgttaacaaacaagaaggaaaaagtttatacgttaaaggagaaccaattataaacttttacgacccactcgtattcccatctgatgaatttgacgcatcaatctcacaagtaaatgaaaaaatcaatcagtcccttgcctttataagaaaatcagatgaacttttacacaacgttaacgccggaaaatcaacaaccaatataatgatcacaaccataataatagttataattgtaattttattatccttaatagccgtcggactactactatactgcaaagcaagatctacacccgtaaccctatcaaaagaccaactaagtggaataaataacattgcattctcaaattaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4218 - RNA, 1825 nt, synthetic construct
  misc_feature 1..1825: note = mRNA product Design i-3 comprising derived and/or modified sequence from HRSV(A2)__F_DSCav1_mut0 (opt11)
  source 1..1825: mol_type = other RNA
gggagaaagcttaccatggaactcctaatactaaaggcaaacgcaatcactacaattctaaccgccgtgacattctgcttcgcctccggacaaaacatcaccgaagaattttaccaatccacatgctcggccgtcagtaaaggctacctctcggctctccgaaccggctggtacacctccgtcatcaccatcgaactctccaacatcaaagaaaacaaatgcaacggcaccgacgccaaagtcaaactaatcaaacaagaactcgacaaatacaaaaacgccgtcacagaactccaactactaatgcaatcaacacccgctacaggaagcggctccgccatcgccagcggcgtagctgtctgcaaagtcctccacctcgaaggtgaagtcaacaaaatcaaatcagccctactcagcacaaacaaagccgttgtaagcctatccaacggcgtctccgtactaacattcaaagtccttgacctcaagaactacatcgacaaacaacttctcccaatcctaaacaaacaaagctgctcaatttccaacatcgaaacagtaatcgaatttcaacaaaaaaacaaccgactcctcgaaatcacccgcgaattttccgttaacgccggcgttacaacccccgtctccacctacatgctcaccaattccgaactactatcactcataaacgacatgcctatcacaaacgaccaaaaaaaactaatgtcaaacaatgtccaaatcgtccgccagcaaagctattccatcatgtgcatcatcaaagaggaagtcctcgcctacgtagtccaactgcccctctacggcgtcattgataccccctgctggaaactccacacctcccccctctgcaccacaaacaccaaagaaggttccaacatctgcctaacacgaaccgacagaggctggtactgcgacaacgccggcagcgtctccttcttcccccaagcagaaacctgtaaagtccagtctaaccgcgtcttctgcgacacaatgaactcaagaaccctaccttccgaagtaaacctctgcaacgtagacatcttcaaccctaaatacgactgcaaaatcatgacttcaaaaacagacgtaagctcttccgtaatcacttccctcggcgccatcgtatcctgctacggtaaaaccaaatgcaccgcctccaacaaaaaccgagggatcataaaaaccttctccaacggctgcgactacgtatctaacaaaggcgtcgacaccgtctccgtcggcaacaccctctattacgtaaacaaacaagagggcaaatcactatacgtcaaaggcgagccaatcataaacttctatgacccactcgtcttcccttcagacgaatttgatgccagcatcagccaagtcaacgaaaaaatcaaccaatcactcgccttcatccgcaaaagcgacgaactccttcacaacgtcaacgcaggcaaatcaaccaccaacatcatgatcaccaccatcatcatcgtcatcatcgttatcctactcagcctcatcgcagttggtcttctcctttactgcaaagcccgctccacccccgtcaccctcagtaaagaccaactcagcggaatcaacaacatagcattctccaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4219 - protein, 514 aa, synthetic construct
  REGION 1..514: note = derived and/or modified protein sequence (artificial) from HRSV(A2)__F-del_DSCav1_mut0
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 4220 - RNA, 1545 nt, synthetic construct
  misc_feature 1..1545: note = derived and/or modified CDS sequence (opt1) from HRSV(A2)__F-del_DSCav1_mut0
  source 1..1545: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtga

SEQ ID NO: 4221 - RNA, 1545 nt, synthetic construct
  misc_feature 1..1545: note = derived and/or modified CDS sequence (opt1) from HRSV(A2)__F-del_DSCav1_mut0
  source 1..1545: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtga

SEQ ID NO: 4222 - RNA, 1545 nt, synthetic construct
  misc_feature 1..1545: note = derived and/or modified CDS sequence (opt2) from HRSV(A2)__F-del_DSCav1_mut0
  source 1..1545: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctga

SEQ ID NO: 4223 - RNA, 1545 nt, synthetic construct
  misc_feature 1..1545: note = derived and/or modified CDS sequence (opt3) from HRSV(A2)__F-del_DSCav1_mut0
  source 1..1545: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctga

SEQ ID NO: 4224 - RNA, 1545 nt, synthetic construct
  misc_feature 1..1545: note = derived and/or modified CDS sequence (opt4) from HRSV(A2)__F-del_DSCav1_mut0
  source 1..1545: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatga

SEQ ID NO: 4225 - RNA, 1545 nt, synthetic construct
  misc_feature 1..1545: note = derived and/or modified CDS sequence (opt5) from HRSV(A2)__F-del_DSCav1_mut0
  source 1..1545: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatga

SEQ ID NO: 4226 - RNA, 1545 nt, synthetic construct
  misc_feature 1..1545: note = derived and/or modified CDS sequence (opt6) from HRSV(A2)__F-del_DSCav1_mut0
  source 1..1545: mol_type = other RNA
atggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataa

SEQ ID NO: 4227 - RNA, 1545 nt, synthetic construct
  misc_feature 1..1545: note = derived and/or modified CDS sequence (opt11) from HRSV(A2)__F-del_DSCav1_mut0
  source 1..1545: mol_type = other RNA
atggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaa

SEQ ID NO: 4228 - RNA, 1821 nt, synthetic construct
  misc_feature 1..1821: note = mRNA product Design a-1 comprising derived and/or modified sequence from HRSV(A2)__F-del_DSCav1_mut0 (opt1)
  source 1..1821: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4229 - RNA, 1821 nt, synthetic construct
  misc_feature 1..1821: note = mRNA product Design a-1 comprising derived and/or modified sequence from HRSV(A2)__F-del_DSCav1_mut0 (opt1)
  source 1..1821: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4230 - RNA, 1821 nt, synthetic construct
  misc_feature 1..1821: note = mRNA product Design a-1 comprising derived and/or modified sequence from HRSV(A2)__F-del_DSCav1_mut0 (opt2)
  source 1..1821: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4231 - RNA, 1821 nt, synthetic construct
  misc_feature 1..1821: note = mRNA product Design a-1 comprising derived and/or modified sequence from HRSV(A2)__F-del_DSCav1_mut0 (opt3)
  source 1..1821: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4232 - RNA, 1821 nt, synthetic construct
  misc_feature 1..1821: note = mRNA product Design a-1 comprising derived and/or modified sequence from HRSV(A2)__F-del_DSCav1_mut0 (opt4)
  source 1..1821: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4233 - RNA, 1821 nt, synthetic construct
  misc_feature 1..1821: note = mRNA product Design a-1 comprising derived and/or modified sequence from HRSV(A2)__F-del_DSCav1_mut0 (opt5)
  source 1..1821: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4234 - RNA, 1821 nt, synthetic construct
  misc_feature 1..1821: note = mRNA product Design a-1 comprising derived and/or modified sequence from HRSV(A2)__F-del_DSCav1_mut0 (opt6)
  source 1..1821: mol_type = other RNA
gggagagtcccgcagtcggcgtccagcggctctgcttgttcgtgtgtgtgtcgttgcaggccttattcaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4235 - RNA, 1821 nt, synthetic construct
  misc_feature 1..1821: note = mRNA product Design a-1 comprising derived and/or modified sequence from HRSV(A2)__F-del_DSCav1_mut0 (opt11)
  source 1..1821: mol_type = other RNA
gggagagtcccgcagtcggcgtccagcggctctgcttgttcgtgtgtgtgtcgttgcaggccttattcaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4236 - RNA, 1840 nt, synthetic construct
  misc_feature 1..1840: note = mRNA product Design a-2 comprising derived and/or modified sequence from HRSV(A2)__F-del_DSCav1_mut0 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4237 - RNA, 1840 nt, synthetic construct
  misc_feature 1..1840: note = mRNA product Design a-2 comprising derived and/or modified sequence from HRSV(A2)__F-del_DSCav1_mut0 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4238 - RNA, 1840 nt, synthetic construct
  misc_feature 1..1840: note = mRNA product Design a-2 comprising derived and/or modified sequence from HRSV(A2)__F-del_DSCav1_mut0 (opt2)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4239 - RNA, 1840 nt, synthetic construct
  misc_feature 1..1840: note = mRNA product Design a-2 comprising derived and/or modified sequence from HRSV(A2)__F-del_DSCav1_mut0 (opt3)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4240 - RNA, 1840 nt, synthetic construct
  misc_feature 1..1840: note = mRNA product Design a-2 comprising derived and/or modified sequence from HRSV(A2)__F-del_DSCav1_mut0 (opt4)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4241 - RNA, 1840 nt, synthetic construct
  misc_feature 1..1840: note = mRNA product Design a-2 comprising derived and/or modified sequence from HRSV(A2)__F-del_DSCav1_mut0 (opt5)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4242 - RNA, 1840 nt, synthetic construct
  misc_feature 1..1840: note = mRNA product Design a-2 comprising derived and/or modified sequence from HRSV(A2)__F-del_DSCav1_mut0 (opt6)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4243 - RNA, 1840 nt, synthetic construct
  misc_feature 1..1840: note = mRNA product Design a-2 comprising derived and/or modified sequence from HRSV(A2)__F-del_DSCav1_mut0 (opt11)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4244 - RNA, 1918 nt, synthetic construct
  misc_feature 1..1918: note = mRNA product Design a-3 comprising derived and/or modified sequence from HRSV(A2)__F-del_DSCav1_mut0 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4245 - RNA, 1918 nt, synthetic construct
  misc_feature 1..1918: note = mRNA product Design a-3 comprising derived and/or modified sequence from HRSV(A2)__F-del_DSCav1_mut0 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4246 - RNA, 1918 nt, synthetic construct
  misc_feature 1..1918: note = mRNA product Design a-3 comprising derived and/or modified sequence from HRSV(A2)__F-del_DSCav1_mut0 (opt2)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4247 - RNA, 1918 nt, synthetic construct
  misc_feature 1..1918: note = mRNA product Design a-3 comprising derived and/or modified sequence from HRSV(A2)__F-del_DSCav1_mut0 (opt3)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4248 - RNA, 1918 nt, synthetic construct
  misc_feature 1..1918: note = mRNA product Design a-3 comprising derived and/or modified sequence from HRSV(A2)__F-del_DSCav1_mut0 (opt4)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4249 - RNA, 1918 nt, synthetic construct
  misc_feature 1..1918: note = mRNA product Design a-3 comprising derived and/or modified sequence from HRSV(A2)__F-del_DSCav1_mut0 (opt5)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4250 - RNA, 1918 nt, synthetic construct
  misc_feature 1..1918: note = mRNA product Design a-3 comprising derived and/or modified sequence from HRSV(A2)__F-del_DSCav1_mut0 (opt6)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4251 - RNA, 1918 nt, synthetic construct
  misc_feature 1..1918: note = mRNA product Design a-3 comprising derived and/or modified sequence from HRSV(A2)__F-del_DSCav1_mut0 (opt11)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4252 - RNA, 1867 nt, synthetic construct
  misc_feature 1..1867: note = mRNA product Design a-4 comprising derived and/or modified sequence from HRSV(A2)__F-del_DSCav1_mut0 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4253 - RNA, 1867 nt, synthetic construct
  misc_feature 1..1867: note = mRNA product Design a-4 comprising derived and/or modified sequence from HRSV(A2)__F-del_DSCav1_mut0 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4254 - RNA, 1867 nt, synthetic construct
  misc_feature 1..1867: note = mRNA product Design a-4 comprising derived and/or modified sequence from HRSV(A2)__F-del_DSCav1_mut0 (opt2)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4255 - RNA, 1867 nt, synthetic construct
  misc_feature 1..1867: note = mRNA product Design a-4 comprising derived and/or modified sequence from HRSV(A2)__F-del_DSCav1_mut0 (opt3)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4256 - RNA, 1867 nt, synthetic construct
  misc_feature 1..1867: note = mRNA product Design a-4 comprising derived and/or modified sequence from HRSV(A2)__F-del_DSCav1_mut0 (opt4)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4257 - RNA, 1867 nt, synthetic construct
  misc_feature 1..1867: note = mRNA product Design a-4 comprising derived and/or modified sequence from HRSV(A2)__F-del_DSCav1_mut0 (opt5)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4258 - RNA, 1867 nt, synthetic construct
  misc_feature 1..1867: note = mRNA product Design a-4 comprising derived and/or modified sequence from HRSV(A2)__F-del_DSCav1_mut0 (opt6)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4259 - RNA, 1867 nt, synthetic construct
  misc_feature 1..1867: note = mRNA product Design a-4 comprising derived and/or modified sequence from HRSV(A2)__F-del_DSCav1_mut0 (opt11)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4260 - RNA, 1813 nt, synthetic construct
  misc_feature 1..1813: note = mRNA product Design a-5 comprising derived and/or modified sequence from HRSV(A2)__F-del_DSCav1_mut0 (opt1)
  source 1..1813: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4261 - RNA, 1813 nt, synthetic construct
  misc_feature 1..1813: note = mRNA product Design a-5 comprising derived and/or modified sequence from HRSV(A2)__F-del_DSCav1_mut0 (opt1)
  source 1..1813: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4262 - RNA, 1813 nt, synthetic construct
  misc_feature 1..1813: note = mRNA product Design a-5 comprising derived and/or modified sequence from HRSV(A2)__F-del_DSCav1_mut0 (opt2)
  source 1..1813: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4263 - RNA, 1813 nt, synthetic construct
  misc_feature 1..1813: note = mRNA product Design a-5 comprising derived and/or modified sequence from HRSV(A2)__F-del_DSCav1_mut0 (opt3)
  source 1..1813: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4264 - RNA, 1813 nt, synthetic construct
  misc_feature 1..1813: note = mRNA product Design a-5 comprising derived and/or modified sequence from HRSV(A2)__F-del_DSCav1_mut0 (opt4)
  source 1..1813: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4265 - RNA, 1813 nt, synthetic construct
  misc_feature 1..1813: note = mRNA product Design a-5 comprising derived and/or modified sequence from HRSV(A2)__F-del_DSCav1_mut0 (opt5)
  source 1..1813: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4266 - RNA, 1813 nt, synthetic construct
  misc_feature 1..1813: note = mRNA product Design a-5 comprising derived and/or modified sequence from HRSV(A2)__F-del_DSCav1_mut0 (opt6)
  source 1..1813: mol_type = other RNA
gggagactttcccattctgtagcagaatttggtgttgcctgtggtcttggtcccgcggagaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4267 - RNA, 1813 nt, synthetic construct
  misc_feature 1..1813: note = mRNA product Design a-5 comprising derived and/or modified sequence from HRSV(A2)__F-del_DSCav1_mut0 (opt11)
  source 1..1813: mol_type = other RNA
gggagactttcccattctgtagcagaatttggtgttgcctgtggtcttggtcccgcggagaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4268 - RNA, 1994 nt, synthetic construct
  misc_feature 1..1994: note = mRNA product Design b-1 comprising derived and/or modified sequence from HRSV(A2)__F-del_DSCav1_mut0 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4269 - RNA, 1994 nt, synthetic construct
  misc_feature 1..1994: note = mRNA product Design b-1 comprising derived and/or modified sequence from HRSV(A2)__F-del_DSCav1_mut0 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4270 - RNA, 1994 nt, synthetic construct
  misc_feature 1..1994: note = mRNA product Design b-1 comprising derived and/or modified sequence from HRSV(A2)__F-del_DSCav1_mut0 (opt2)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4271 - RNA, 1994 nt, synthetic construct
  misc_feature 1..1994: note = mRNA product Design b-1 comprising derived and/or modified sequence from HRSV(A2)__F-del_DSCav1_mut0 (opt3)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4272 - RNA, 1994 nt, synthetic construct
  misc_feature 1..1994: note = mRNA product Design b-1 comprising derived and/or modified sequence from HRSV(A2)__F-del_DSCav1_mut0 (opt4)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4273 - RNA, 1994 nt, synthetic construct
  misc_feature 1..1994: note = mRNA product Design b-1 comprising derived and/or modified sequence from HRSV(A2)__F-del_DSCav1_mut0 (opt5)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4274 - RNA, 1994 nt, synthetic construct
  misc_feature 1..1994: note = mRNA product Design b-1 comprising derived and/or modified sequence from HRSV(A2)__F-del_DSCav1_mut0 (opt6)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4275 - RNA, 1994 nt, synthetic construct
  misc_feature 1..1994: note = mRNA product Design b-1 comprising derived and/or modified sequence from HRSV(A2)__F-del_DSCav1_mut0 (opt11)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4276 - RNA, 1814 nt, synthetic construct
  misc_feature 1..1814: note = mRNA product Design b-2 comprising derived and/or modified sequence from HRSV(A2)__F-del_DSCav1_mut0 (opt1)
  source 1..1814: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4277 - RNA, 1814 nt, synthetic construct
  misc_feature 1..1814: note = mRNA product Design b-2 comprising derived and/or modified sequence from HRSV(A2)__F-del_DSCav1_mut0 (opt1)
  source 1..1814: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4278 - RNA, 1814 nt, synthetic construct
  misc_feature 1..1814: note = mRNA product Design b-2 comprising derived and/or modified sequence from HRSV(A2)__F-del_DSCav1_mut0 (opt2)
  source 1..1814: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4279 - RNA, 1814 nt, synthetic construct
  misc_feature 1..1814: note = mRNA product Design b-2 comprising derived and/or modified sequence from HRSV(A2)__F-del_DSCav1_mut0 (opt3)
  source 1..1814: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4280 - RNA, 1814 nt, synthetic construct
  misc_feature 1..1814: note = mRNA product Design b-2 comprising derived and/or modified sequence from HRSV(A2)__F-del_DSCav1_mut0 (opt4)
  source 1..1814: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4281 - RNA, 1814 nt, synthetic construct
  misc_feature 1..1814: note = mRNA product Design b-2 comprising derived and/or modified sequence from HRSV(A2)__F-del_DSCav1_mut0 (opt5)
  source 1..1814: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4282 - RNA, 1814 nt, synthetic construct
  misc_feature 1..1814: note = mRNA product Design b-2 comprising derived and/or modified sequence from HRSV(A2)__F-del_DSCav1_mut0 (opt6)
  source 1..1814: mol_type = other RNA
gggagagcctctgctggagtccggggagtggcgttggctgctagagcgaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4283 - RNA, 1814 nt, synthetic construct
  misc_feature 1..1814: note = mRNA product Design b-2 comprising derived and/or modified sequence from HRSV(A2)__F-del_DSCav1_mut0 (opt11)
  source 1..1814: mol_type = other RNA
gggagagcctctgctggagtccggggagtggcgttggctgctagagcgaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4284 - RNA, 1834 nt, synthetic construct
  misc_feature 1..1834: note = mRNA product Design b-3 comprising derived and/or modified sequence from HRSV(A2)__F-del_DSCav1_mut0 (opt1)
  source 1..1834: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4285 - RNA, 1834 nt, synthetic construct
  misc_feature 1..1834: note = mRNA product Design b-3 comprising derived and/or modified sequence from HRSV(A2)__F-del_DSCav1_mut0 (opt1)
  source 1..1834: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4286 - RNA, 1834 nt, synthetic construct
  misc_feature 1..1834: note = mRNA product Design b-3 comprising derived and/or modified sequence from HRSV(A2)__F-del_DSCav1_mut0 (opt2)
  source 1..1834: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4287 - RNA, 1834 nt, synthetic construct
  misc_feature 1..1834: note = mRNA product Design b-3 comprising derived and/or modified sequence from HRSV(A2)__F-del_DSCav1_mut0 (opt3)
  source 1..1834: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4288 - RNA, 1834 nt, synthetic construct
  misc_feature 1..1834: note = mRNA product Design b-3 comprising derived and/or modified sequence from HRSV(A2)__F-del_DSCav1_mut0 (opt4)
  source 1..1834: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4289 - RNA, 1834 nt, synthetic construct
  misc_feature 1..1834: note = mRNA product Design b-3 comprising derived and/or modified sequence from HRSV(A2)__F-del_DSCav1_mut0 (opt5)
  source 1..1834: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4290 - RNA, 1834 nt, synthetic construct
  misc_feature 1..1834: note = mRNA product Design b-3 comprising derived and/or modified sequence from HRSV(A2)__F-del_DSCav1_mut0 (opt6)
  source 1..1834: mol_type = other RNA
gggagagtcccgcagtcggcgtccagcggctctgcttgttcgtgtgtgtgtcgttgcaggccttattcaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4291 - RNA, 1834 nt, synthetic construct
  misc_feature 1..1834: note = mRNA product Design b-3 comprising derived and/or modified sequence from HRSV(A2)__F-del_DSCav1_mut0 (opt11)
  source 1..1834: mol_type = other RNA
gggagagtcccgcagtcggcgtccagcggctctgcttgttcgtgtgtgtgtcgttgcaggccttattcaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4292 - RNA, 1885 nt, synthetic construct
  misc_feature 1..1885: note = mRNA product Design b-4 comprising derived and/or modified sequence from HRSV(A2)__F-del_DSCav1_mut0 (opt1)
  source 1..1885: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4293 - RNA, 1885 nt, synthetic construct
  misc_feature 1..1885: note = mRNA product Design b-4 comprising derived and/or modified sequence from HRSV(A2)__F-del_DSCav1_mut0 (opt1)
  source 1..1885: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4294 - RNA, 1885 nt, synthetic construct
  misc_feature 1..1885: note = mRNA product Design b-4 comprising derived and/or modified sequence from HRSV(A2)__F-del_DSCav1_mut0 (opt2)
  source 1..1885: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4295 - RNA, 1885 nt, synthetic construct
  misc_feature 1..1885: note = mRNA product Design b-4 comprising derived and/or modified sequence from HRSV(A2)__F-del_DSCav1_mut0 (opt3)
  source 1..1885: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4296 - RNA, 1885 nt, synthetic construct
  misc_feature 1..1885: note = mRNA product Design b-4 comprising derived and/or modified sequence from HRSV(A2)__F-del_DSCav1_mut0 (opt4)
  source 1..1885: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4297 - RNA, 1885 nt, synthetic construct
  misc_feature 1..1885: note = mRNA product Design b-4 comprising derived and/or modified sequence from HRSV(A2)__F-del_DSCav1_mut0 (opt5)
  source 1..1885: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4298 - RNA, 1885 nt, synthetic construct
  misc_feature 1..1885: note = mRNA product Design b-4 comprising derived and/or modified sequence from HRSV(A2)__F-del_DSCav1_mut0 (opt6)
  source 1..1885: mol_type = other RNA
gggagagtcccgcagtcggcgtccagcggctctgcttgttcgtgtgtgtgtcgttgcaggccttattcaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4299 - RNA, 1885 nt, synthetic construct
  misc_feature 1..1885: note = mRNA product Design b-4 comprising derived and/or modified sequence from HRSV(A2)__F-del_DSCav1_mut0 (opt11)
  source 1..1885: mol_type = other RNA
gggagagtcccgcagtcggcgtccagcggctctgcttgttcgtgtgtgtgtcgttgcaggccttattcaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4300 - RNA, 1947 nt, synthetic construct
  misc_feature 1..1947: note = mRNA product Design b-5 comprising derived and/or modified sequence from HRSV(A2)__F-del_DSCav1_mut0 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4301 - RNA, 1947 nt, synthetic construct
  misc_feature 1..1947: note = mRNA product Design b-5 comprising derived and/or modified sequence from HRSV(A2)__F-del_DSCav1_mut0 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4302 - RNA, 1947 nt, synthetic construct
  misc_feature 1..1947: note = mRNA product Design b-5 comprising derived and/or modified sequence from HRSV(A2)__F-del_DSCav1_mut0 (opt2)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4303 - RNA, 1947 nt, synthetic construct
  misc_feature 1..1947: note = mRNA product Design b-5 comprising derived and/or modified sequence from HRSV(A2)__F-del_DSCav1_mut0 (opt3)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4304 - RNA, 1947 nt, synthetic construct
  misc_feature 1..1947: note = mRNA product Design b-5 comprising derived and/or modified sequence from HRSV(A2)__F-del_DSCav1_mut0 (opt4)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4305 - RNA, 1947 nt, synthetic construct
  misc_feature 1..1947: note = mRNA product Design b-5 comprising derived and/or modified sequence from HRSV(A2)__F-del_DSCav1_mut0 (opt5)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4306 - RNA, 1947 nt, synthetic construct
  misc_feature 1..1947: note = mRNA product Design b-5 comprising derived and/or modified sequence from HRSV(A2)__F-del_DSCav1_mut0 (opt6)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4307 - RNA, 1947 nt, synthetic construct
  misc_feature 1..1947: note = mRNA product Design b-5 comprising derived and/or modified sequence from HRSV(A2)__F-del_DSCav1_mut0 (opt11)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4308 - RNA, 1853 nt, synthetic construct
  misc_feature 1..1853: note = mRNA product Design c-1 comprising derived and/or modified sequence from HRSV(A2)__F-del_DSCav1_mut0 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4309 - RNA, 1853 nt, synthetic construct
  misc_feature 1..1853: note = mRNA product Design c-1 comprising derived and/or modified sequence from HRSV(A2)__F-del_DSCav1_mut0 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4310 - RNA, 1853 nt, synthetic construct
  misc_feature 1..1853: note = mRNA product Design c-1 comprising derived and/or modified sequence from HRSV(A2)__F-del_DSCav1_mut0 (opt2)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4311 - RNA, 1853 nt, synthetic construct
  misc_feature 1..1853: note = mRNA product Design c-1 comprising derived and/or modified sequence from HRSV(A2)__F-del_DSCav1_mut0 (opt3)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4312 - RNA, 1853 nt, synthetic construct
  misc_feature 1..1853: note = mRNA product Design c-1 comprising derived and/or modified sequence from HRSV(A2)__F-del_DSCav1_mut0 (opt4)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4313 - RNA, 1853 nt, synthetic construct
  misc_feature 1..1853: note = mRNA product Design c-1 comprising derived and/or modified sequence from HRSV(A2)__F-del_DSCav1_mut0 (opt5)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4314 - RNA, 1853 nt, synthetic construct
  misc_feature 1..1853: note = mRNA product Design c-1 comprising derived and/or modified sequence from HRSV(A2)__F-del_DSCav1_mut0 (opt6)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4315 - RNA, 1853 nt, synthetic construct
  misc_feature 1..1853: note = mRNA product Design c-1 comprising derived and/or modified sequence from HRSV(A2)__F-del_DSCav1_mut0 (opt11)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4316 - RNA, 1943 nt, synthetic construct
  misc_feature 1..1943: note = mRNA product Design c-2 comprising derived and/or modified sequence from HRSV(A2)__F-del_DSCav1_mut0 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4317 - RNA, 1943 nt, synthetic construct
  misc_feature 1..1943: note = mRNA product Design c-2 comprising derived and/or modified sequence from HRSV(A2)__F-del_DSCav1_mut0 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4318 - RNA, 1943 nt, synthetic construct
  misc_feature 1..1943: note = mRNA product Design c-2 comprising derived and/or modified sequence from HRSV(A2)__F-del_DSCav1_mut0 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4319 - RNA, 1943 nt, synthetic construct
  misc_feature 1..1943: note = mRNA product Design c-2 comprising derived and/or modified sequence from HRSV(A2)__F-del_DSCav1_mut0 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4320 - RNA, 1943 nt, synthetic construct
  misc_feature 1..1943: note = mRNA product Design c-2 comprising derived and/or modified sequence from HRSV(A2)__F-del_DSCav1_mut0 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4321 - RNA, 1943 nt, synthetic construct
  misc_feature 1..1943: note = mRNA product Design c-2 comprising derived and/or modified sequence from HRSV(A2)__F-del_DSCav1_mut0 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4322 - RNA, 1943 nt, synthetic construct
  misc_feature 1..1943: note = mRNA product Design c-2 comprising derived and/or modified sequence from HRSV(A2)__F-del_DSCav1_mut0 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4323 - RNA, 1943 nt, synthetic construct
  misc_feature 1..1943: note = mRNA product Design c-2 comprising derived and/or modified sequence from HRSV(A2)__F-del_DSCav1_mut0 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4324 - RNA, 1920 nt, synthetic construct
  misc_feature 1..1920: note = mRNA product Design c-3 comprising derived and/or modified sequence from HRSV(A2)__F-del_DSCav1_mut0 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4325 - RNA, 1920 nt, synthetic construct
  misc_feature 1..1920: note = mRNA product Design c-3 comprising derived and/or modified sequence from HRSV(A2)__F-del_DSCav1_mut0 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4326 - RNA, 1920 nt, synthetic construct
  misc_feature 1..1920: note = mRNA product Design c-3 comprising derived and/or modified sequence from HRSV(A2)__F-del_DSCav1_mut0 (opt2)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4327 - RNA, 1920 nt, synthetic construct
  misc_feature 1..1920: note = mRNA product Design c-3 comprising derived and/or modified sequence from HRSV(A2)__F-del_DSCav1_mut0 (opt3)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4328 - RNA, 1920 nt, synthetic construct
  misc_feature 1..1920: note = mRNA product Design c-3 comprising derived and/or modified sequence from HRSV(A2)__F-del_DSCav1_mut0 (opt4)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4329 - RNA, 1920 nt, synthetic construct
  misc_feature 1..1920: note = mRNA product Design c-3 comprising derived and/or modified sequence from HRSV(A2)__F-del_DSCav1_mut0 (opt5)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4330 - RNA, 1920 nt, synthetic construct
  misc_feature 1..1920: note = mRNA product Design c-3 comprising derived and/or modified sequence from HRSV(A2)__F-del_DSCav1_mut0 (opt6)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4331 - RNA, 1920 nt, synthetic construct
  misc_feature 1..1920: note = mRNA product Design c-3 comprising derived and/or modified sequence from HRSV(A2)__F-del_DSCav1_mut0 (opt11)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4332 - RNA, 1916 nt, synthetic construct
  misc_feature 1..1916: note = mRNA product Design c-4 comprising derived and/or modified sequence from HRSV(A2)__F-del_DSCav1_mut0 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4333 - RNA, 1916 nt, synthetic construct
  misc_feature 1..1916: note = mRNA product Design c-4 comprising derived and/or modified sequence from HRSV(A2)__F-del_DSCav1_mut0 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4334 - RNA, 1916 nt, synthetic construct
  misc_feature 1..1916: note = mRNA product Design c-4 comprising derived and/or modified sequence from HRSV(A2)__F-del_DSCav1_mut0 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4335 - RNA, 1916 nt, synthetic construct
  misc_feature 1..1916: note = mRNA product Design c-4 comprising derived and/or modified sequence from HRSV(A2)__F-del_DSCav1_mut0 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4336 - RNA, 1916 nt, synthetic construct
  misc_feature 1..1916: note = mRNA product Design c-4 comprising derived and/or modified sequence from HRSV(A2)__F-del_DSCav1_mut0 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4337 - RNA, 1916 nt, synthetic construct
  misc_feature 1..1916: note = mRNA product Design c-4 comprising derived and/or modified sequence from HRSV(A2)__F-del_DSCav1_mut0 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4338 - RNA, 1916 nt, synthetic construct
  misc_feature 1..1916: note = mRNA product Design c-4 comprising derived and/or modified sequence from HRSV(A2)__F-del_DSCav1_mut0 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4339 - RNA, 1916 nt, synthetic construct
  misc_feature 1..1916: note = mRNA product Design c-4 comprising derived and/or modified sequence from HRSV(A2)__F-del_DSCav1_mut0 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4340 - RNA, 1834 nt, synthetic construct
  misc_feature 1..1834: note = mRNA product Design c-5 comprising derived and/or modified sequence from HRSV(A2)__F-del_DSCav1_mut0 (opt1)
  source 1..1834: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4341 - RNA, 1834 nt, synthetic construct
  misc_feature 1..1834: note = mRNA product Design c-5 comprising derived and/or modified sequence from HRSV(A2)__F-del_DSCav1_mut0 (opt1)
  source 1..1834: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4342 - RNA, 1834 nt, synthetic construct
  misc_feature 1..1834: note = mRNA product Design c-5 comprising derived and/or modified sequence from HRSV(A2)__F-del_DSCav1_mut0 (opt2)
  source 1..1834: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4343 - RNA, 1834 nt, synthetic construct
  misc_feature 1..1834: note = mRNA product Design c-5 comprising derived and/or modified sequence from HRSV(A2)__F-del_DSCav1_mut0 (opt3)
  source 1..1834: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4344 - RNA, 1834 nt, synthetic construct
  misc_feature 1..1834: note = mRNA product Design c-5 comprising derived and/or modified sequence from HRSV(A2)__F-del_DSCav1_mut0 (opt4)
  source 1..1834: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4345 - RNA, 1834 nt, synthetic construct
  misc_feature 1..1834: note = mRNA product Design c-5 comprising derived and/or modified sequence from HRSV(A2)__F-del_DSCav1_mut0 (opt5)
  source 1..1834: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4346 - RNA, 1834 nt, synthetic construct
  misc_feature 1..1834: note = mRNA product Design c-5 comprising derived and/or modified sequence from HRSV(A2)__F-del_DSCav1_mut0 (opt6)
  source 1..1834: mol_type = other RNA
gggagagcggctcggccattttgtcccagtcagtccggaggctgcggctgcagaagtaccgcctgcggagtaactgcaaagaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4347 - RNA, 1834 nt, synthetic construct
  misc_feature 1..1834: note = mRNA product Design c-5 comprising derived and/or modified sequence from HRSV(A2)__F-del_DSCav1_mut0 (opt11)
  source 1..1834: mol_type = other RNA
gggagagcggctcggccattttgtcccagtcagtccggaggctgcggctgcagaagtaccgcctgcggagtaactgcaaagaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4348 - RNA, 1843 nt, synthetic construct
  misc_feature 1..1843: note = mRNA product Design d-1 comprising derived and/or modified sequence from HRSV(A2)__F-del_DSCav1_mut0 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4349 - RNA, 1843 nt, synthetic construct
  misc_feature 1..1843: note = mRNA product Design d-1 comprising derived and/or modified sequence from HRSV(A2)__F-del_DSCav1_mut0 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4350 - RNA, 1843 nt, synthetic construct
  misc_feature 1..1843: note = mRNA product Design d-1 comprising derived and/or modified sequence from HRSV(A2)__F-del_DSCav1_mut0 (opt2)
  source 1..1843: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4351 - RNA, 1843 nt, synthetic construct
  misc_feature 1..1843: note = mRNA product Design d-1 comprising derived and/or modified sequence from HRSV(A2)__F-del_DSCav1_mut0 (opt3)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4352 - RNA, 1843 nt, synthetic construct
  misc_feature 1..1843: note = mRNA product Design d-1 comprising derived and/or modified sequence from HRSV(A2)__F-del_DSCav1_mut0 (opt4)
  source 1..1843: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4353 - RNA, 1843 nt, synthetic construct
  misc_feature 1..1843: note = mRNA product Design d-1 comprising derived and/or modified sequence from HRSV(A2)__F-del_DSCav1_mut0 (opt5)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4354 - RNA, 1843 nt, synthetic construct
  misc_feature 1..1843: note = mRNA product Design d-1 comprising derived and/or modified sequence from HRSV(A2)__F-del_DSCav1_mut0 (opt6)
  source 1..1843: mol_type = other RNA
gggagacccgtgacccggaagttgtacggctacgcgactttccctcccacaaaccctcgcgcccttcctttcctacttgggcccggcagaaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4355 - RNA, 1843 nt, synthetic construct
  misc_feature 1..1843: note = mRNA product Design d-1 comprising derived and/or modified sequence from HRSV(A2)__F-del_DSCav1_mut0 (opt11)
  source 1..1843: mol_type = other RNA
gggagacccgtgacccggaagttgtacggctacgcgactttccctcccacaaaccctcgcgcccttcctttcctacttgggcccggcagaaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4356 - RNA, 1898 nt, synthetic construct
  misc_feature 1..1898: note = mRNA product Design d-2 comprising derived and/or modified sequence from HRSV(A2)__F-del_DSCav1_mut0 (opt1)
  source 1..1898: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4357 - RNA, 1898 nt, synthetic construct
  misc_feature 1..1898: note = mRNA product Design d-2 comprising derived and/or modified sequence from HRSV(A2)__F-del_DSCav1_mut0 (opt1)
  source 1..1898: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4358 - RNA, 1898 nt, synthetic construct
  misc_feature 1..1898: note = mRNA product Design d-2 comprising derived and/or modified sequence from HRSV(A2)__F-del_DSCav1_mut0 (opt2)
  source 1..1898: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4359 - RNA, 1898 nt, synthetic construct
  misc_feature 1..1898: note = mRNA product Design d-2 comprising derived and/or modified sequence from HRSV(A2)__F-del_DSCav1_mut0 (opt3)
  source 1..1898: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4360 - RNA, 1898 nt, synthetic construct
  misc_feature 1..1898: note = mRNA product Design d-2 comprising derived and/or modified sequence from HRSV(A2)__F-del_DSCav1_mut0 (opt4)
  source 1..1898: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4361 - RNA, 1898 nt, synthetic construct
  misc_feature 1..1898: note = mRNA product Design d-2 comprising derived and/or modified sequence from HRSV(A2)__F-del_DSCav1_mut0 (opt5)
  source 1..1898: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4362 - RNA, 1898 nt, synthetic construct
  misc_feature 1..1898: note = mRNA product Design d-2 comprising derived and/or modified sequence from HRSV(A2)__F-del_DSCav1_mut0 (opt6)
  source 1..1898: mol_type = other RNA
gggagagcggctcggccattttgtcccagtcagtccggaggctgcggctgcagaagtaccgcctgcggagtaactgcaaagaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4363 - RNA, 1898 nt, synthetic construct
  misc_feature 1..1898: note = mRNA product Design d-2 comprising derived and/or modified sequence from HRSV(A2)__F-del_DSCav1_mut0 (opt11)
  source 1..1898: mol_type = other RNA
gggagagcggctcggccattttgtcccagtcagtccggaggctgcggctgcagaagtaccgcctgcggagtaactgcaaagaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4364 - RNA, 2214 nt, synthetic construct
  misc_feature 1..2214: note = mRNA product Design d-3 comprising derived and/or modified sequence from HRSV(A2)__F-del_DSCav1_mut0 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4365 - RNA, 2214 nt, synthetic construct
  misc_feature 1..2214: note = mRNA product Design d-3 comprising derived and/or modified sequence from HRSV(A2)__F-del_DSCav1_mut0 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4366 - RNA, 2214 nt, synthetic construct
  misc_feature 1..2214: note = mRNA product Design d-3 comprising derived and/or modified sequence from HRSV(A2)__F-del_DSCav1_mut0 (opt2)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4367 - RNA, 2214 nt, synthetic construct
  misc_feature 1..2214: note = mRNA product Design d-3 comprising derived and/or modified sequence from HRSV(A2)__F-del_DSCav1_mut0 (opt3)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4368 - RNA, 2214 nt, synthetic construct
  misc_feature 1..2214: note = mRNA product Design d-3 comprising derived and/or modified sequence from HRSV(A2)__F-del_DSCav1_mut0 (opt4)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4369 - RNA, 2214 nt, synthetic construct
  misc_feature 1..2214: note = mRNA product Design d-3 comprising derived and/or modified sequence from HRSV(A2)__F-del_DSCav1_mut0 (opt5)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4370 - RNA, 2214 nt, synthetic construct
  misc_feature 1..2214: note = mRNA product Design d-3 comprising derived and/or modified sequence from HRSV(A2)__F-del_DSCav1_mut0 (opt6)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4371 - RNA, 2214 nt, synthetic construct
  misc_feature 1..2214: note = mRNA product Design d-3 comprising derived and/or modified sequence from HRSV(A2)__F-del_DSCav1_mut0 (opt11)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4372 - RNA, 1897 nt, synthetic construct
  misc_feature 1..1897: note = mRNA product Design d-4 comprising derived and/or modified sequence from HRSV(A2)__F-del_DSCav1_mut0 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4373 - RNA, 1897 nt, synthetic construct
  misc_feature 1..1897: note = mRNA product Design d-4 comprising derived and/or modified sequence from HRSV(A2)__F-del_DSCav1_mut0 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4374 - RNA, 1897 nt, synthetic construct
  misc_feature 1..1897: note = mRNA product Design d-4 comprising derived and/or modified sequence from HRSV(A2)__F-del_DSCav1_mut0 (opt2)
  source 1..1897: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4375 - RNA, 1897 nt, synthetic construct
  misc_feature 1..1897: note = mRNA product Design d-4 comprising derived and/or modified sequence from HRSV(A2)__F-del_DSCav1_mut0 (opt3)
  source 1..1897: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4376 - RNA, 1897 nt, synthetic construct
  misc_feature 1..1897: note = mRNA product Design d-4 comprising derived and/or modified sequence from HRSV(A2)__F-del_DSCav1_mut0 (opt4)
  source 1..1897: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4377 - RNA, 1897 nt, synthetic construct
  misc_feature 1..1897: note = mRNA product Design d-4 comprising derived and/or modified sequence from HRSV(A2)__F-del_DSCav1_mut0 (opt5)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4378 - RNA, 1897 nt, synthetic construct
  misc_feature 1..1897: note = mRNA product Design d-4 comprising derived and/or modified sequence from HRSV(A2)__F-del_DSCav1_mut0 (opt6)
  source 1..1897: mol_type = other RNA
gggagagtcccgcagtcggcgtccagcggctctgcttgttcgtgtgtgtgtcgttgcaggccttattcaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4379 - RNA, 1897 nt, synthetic construct
  misc_feature 1..1897: note = mRNA product Design d-4 comprising derived and/or modified sequence from HRSV(A2)__F-del_DSCav1_mut0 (opt11)
  source 1..1897: mol_type = other RNA
gggagagtcccgcagtcggcgtccagcggctctgcttgttcgtgtgtgtgtcgttgcaggccttattcaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4380 - RNA, 1994 nt, synthetic construct
  misc_feature 1..1994: note = mRNA product Design d-5 comprising derived and/or modified sequence from HRSV(A2)__F-del_DSCav1_mut0 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4381 - RNA, 1994 nt, synthetic construct
  misc_feature 1..1994: note = mRNA product Design d-5 comprising derived and/or modified sequence from HRSV(A2)__F-del_DSCav1_mut0 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4382 - RNA, 1994 nt, synthetic construct
  misc_feature 1..1994: note = mRNA product Design d-5 comprising derived and/or modified sequence from HRSV(A2)__F-del_DSCav1_mut0 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4383 - RNA, 1994 nt, synthetic construct
  misc_feature 1..1994: note = mRNA product Design d-5 comprising derived and/or modified sequence from HRSV(A2)__F-del_DSCav1_mut0 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4384 - RNA, 1994 nt, synthetic construct
  misc_feature 1..1994: note = mRNA product Design d-5 comprising derived and/or modified sequence from HRSV(A2)__F-del_DSCav1_mut0 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4385 - RNA, 1994 nt, synthetic construct
  misc_feature 1..1994: note = mRNA product Design d-5 comprising derived and/or modified sequence from HRSV(A2)__F-del_DSCav1_mut0 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4386 - RNA, 1994 nt, synthetic construct
  misc_feature 1..1994: note = mRNA product Design d-5 comprising derived and/or modified sequence from HRSV(A2)__F-del_DSCav1_mut0 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4387 - RNA, 1994 nt, synthetic construct
  misc_feature 1..1994: note = mRNA product Design d-5 comprising derived and/or modified sequence from HRSV(A2)__F-del_DSCav1_mut0 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4388 - RNA, 1874 nt, synthetic construct
  misc_feature 1..1874: note = mRNA product Design e-1 comprising derived and/or modified sequence from HRSV(A2)__F-del_DSCav1_mut0 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4389 - RNA, 1874 nt, synthetic construct
  misc_feature 1..1874: note = mRNA product Design e-1 comprising derived and/or modified sequence from HRSV(A2)__F-del_DSCav1_mut0 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4390 - RNA, 1874 nt, synthetic construct
  misc_feature 1..1874: note = mRNA product Design e-1 comprising derived and/or modified sequence from HRSV(A2)__F-del_DSCav1_mut0 (opt2)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4391 - RNA, 1874 nt, synthetic construct
  misc_feature 1..1874: note = mRNA product Design e-1 comprising derived and/or modified sequence from HRSV(A2)__F-del_DSCav1_mut0 (opt3)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4392 - RNA, 1874 nt, synthetic construct
  misc_feature 1..1874: note = mRNA product Design e-1 comprising derived and/or modified sequence from HRSV(A2)__F-del_DSCav1_mut0 (opt4)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4393 - RNA, 1874 nt, synthetic construct
  misc_feature 1..1874: note = mRNA product Design e-1 comprising derived and/or modified sequence from HRSV(A2)__F-del_DSCav1_mut0 (opt5)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4394 - RNA, 1874 nt, synthetic construct
  misc_feature 1..1874: note = mRNA product Design e-1 comprising derived and/or modified sequence from HRSV(A2)__F-del_DSCav1_mut0 (opt6)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4395 - RNA, 1874 nt, synthetic construct
  misc_feature 1..1874: note = mRNA product Design e-1 comprising derived and/or modified sequence from HRSV(A2)__F-del_DSCav1_mut0 (opt11)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4396 - RNA, 1856 nt, synthetic construct
  misc_feature 1..1856: note = mRNA product Design e-2 comprising derived and/or modified sequence from HRSV(A2)__F-del_DSCav1_mut0 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4397 - RNA, 1856 nt, synthetic construct
  misc_feature 1..1856: note = mRNA product Design e-2 comprising derived and/or modified sequence from HRSV(A2)__F-del_DSCav1_mut0 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4398 - RNA, 1856 nt, synthetic construct
  misc_feature 1..1856: note = mRNA product Design e-2 comprising derived and/or modified sequence from HRSV(A2)__F-del_DSCav1_mut0 (opt2)
  source 1..1856: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4399 - RNA, 1856 nt, synthetic construct
  misc_feature 1..1856: note = mRNA product Design e-2 comprising derived and/or modified sequence from HRSV(A2)__F-del_DSCav1_mut0 (opt3)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4400 - RNA, 1856 nt, synthetic construct
  misc_feature 1..1856: note = mRNA product Design e-2 comprising derived and/or modified sequence from HRSV(A2)__F-del_DSCav1_mut0 (opt4)
  source 1..1856: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4401 - RNA, 1856 nt, synthetic construct
  misc_feature 1..1856: note = mRNA product Design e-2 comprising derived and/or modified sequence from HRSV(A2)__F-del_DSCav1_mut0 (opt5)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4402 - RNA, 1856 nt, synthetic construct
  misc_feature 1..1856: note = mRNA product Design e-2 comprising derived and/or modified sequence from HRSV(A2)__F-del_DSCav1_mut0 (opt6)
  source 1..1856: mol_type = other RNA
gggagacccgtgacccggaagttgtacggctacgcgactttccctcccacaaaccctcgcgcccttcctttcctacttgggcccggcagaaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4403 - RNA, 1856 nt, synthetic construct
  misc_feature 1..1856: note = mRNA product Design e-2 comprising derived and/or modified sequence from HRSV(A2)__F-del_DSCav1_mut0 (opt11)
  source 1..1856: mol_type = other RNA
gggagacccgtgacccggaagttgtacggctacgcgactttccctcccacaaaccctcgcgcccttcctttcctacttgggcccggcagaaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4404 - RNA, 1826 nt, synthetic construct
  misc_feature 1..1826: note = mRNA product Design e-3 comprising derived and/or modified sequence from HRSV(A2)__F-del_DSCav1_mut0 (opt1)
  source 1..1826: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4405 - RNA, 1826 nt, synthetic construct
  misc_feature 1..1826: note = mRNA product Design e-3 comprising derived and/or modified sequence from HRSV(A2)__F-del_DSCav1_mut0 (opt1)
  source 1..1826: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4406 - RNA, 1826 nt, synthetic construct
  misc_feature 1..1826: note = mRNA product Design e-3 comprising derived and/or modified sequence from HRSV(A2)__F-del_DSCav1_mut0 (opt2)
  source 1..1826: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4407 - RNA, 1826 nt, synthetic construct
  misc_feature 1..1826: note = mRNA product Design e-3 comprising derived and/or modified sequence from HRSV(A2)__F-del_DSCav1_mut0 (opt3)
  source 1..1826: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4408 - RNA, 1826 nt, synthetic construct
  misc_feature 1..1826: note = mRNA product Design e-3 comprising derived and/or modified sequence from HRSV(A2)__F-del_DSCav1_mut0 (opt4)
  source 1..1826: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4409 - RNA, 1826 nt, synthetic construct
  misc_feature 1..1826: note = mRNA product Design e-3 comprising derived and/or modified sequence from HRSV(A2)__F-del_DSCav1_mut0 (opt5)
  source 1..1826: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4410 - RNA, 1826 nt, synthetic construct
  misc_feature 1..1826: note = mRNA product Design e-3 comprising derived and/or modified sequence from HRSV(A2)__F-del_DSCav1_mut0 (opt6)
  source 1..1826: mol_type = other RNA
gggagactttcccattctgtagcagaatttggtgttgcctgtggtcttggtcccgcggagaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4411 - RNA, 1826 nt, synthetic construct
  misc_feature 1..1826: note = mRNA product Design e-3 comprising derived and/or modified sequence from HRSV(A2)__F-del_DSCav1_mut0 (opt11)
  source 1..1826: mol_type = other RNA
gggagactttcccattctgtagcagaatttggtgttgcctgtggtcttggtcccgcggagaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4412 - RNA, 1880 nt, synthetic construct
  misc_feature 1..1880: note = mRNA product Design e-4 comprising derived and/or modified sequence from HRSV(A2)__F-del_DSCav1_mut0 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4413 - RNA, 1880 nt, synthetic construct
  misc_feature 1..1880: note = mRNA product Design e-4 comprising derived and/or modified sequence from HRSV(A2)__F-del_DSCav1_mut0 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4414 - RNA, 1880 nt, synthetic construct
  misc_feature 1..1880: note = mRNA product Design e-4 comprising derived and/or modified sequence from HRSV(A2)__F-del_DSCav1_mut0 (opt2)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4415 - RNA, 1880 nt, synthetic construct
  misc_feature 1..1880: note = mRNA product Design e-4 comprising derived and/or modified sequence from HRSV(A2)__F-del_DSCav1_mut0 (opt3)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4416 - RNA, 1880 nt, synthetic construct
  misc_feature 1..1880: note = mRNA product Design e-4 comprising derived and/or modified sequence from HRSV(A2)__F-del_DSCav1_mut0 (opt4)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4417 - RNA, 1880 nt, synthetic construct
  misc_feature 1..1880: note = mRNA product Design e-4 comprising derived and/or modified sequence from HRSV(A2)__F-del_DSCav1_mut0 (opt5)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4418 - RNA, 1880 nt, synthetic construct
  misc_feature 1..1880: note = mRNA product Design e-4 comprising derived and/or modified sequence from HRSV(A2)__F-del_DSCav1_mut0 (opt6)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4419 - RNA, 1880 nt, synthetic construct
  misc_feature 1..1880: note = mRNA product Design e-4 comprising derived and/or modified sequence from HRSV(A2)__F-del_DSCav1_mut0 (opt11)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4420 - RNA, 1847 nt, synthetic construct
  misc_feature 1..1847: note = mRNA product Design e-5 comprising derived and/or modified sequence from HRSV(A2)__F-del_DSCav1_mut0 (opt1)
  source 1..1847: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4421 - RNA, 1847 nt, synthetic construct
  misc_feature 1..1847: note = mRNA product Design e-5 comprising derived and/or modified sequence from HRSV(A2)__F-del_DSCav1_mut0 (opt1)
  source 1..1847: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4422 - RNA, 1847 nt, synthetic construct
  misc_feature 1..1847: note = mRNA product Design e-5 comprising derived and/or modified sequence from HRSV(A2)__F-del_DSCav1_mut0 (opt2)
  source 1..1847: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4423 - RNA, 1847 nt, synthetic construct
  misc_feature 1..1847: note = mRNA product Design e-5 comprising derived and/or modified sequence from HRSV(A2)__F-del_DSCav1_mut0 (opt3)
  source 1..1847: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4424 - RNA, 1847 nt, synthetic construct
  misc_feature 1..1847: note = mRNA product Design e-5 comprising derived and/or modified sequence from HRSV(A2)__F-del_DSCav1_mut0 (opt4)
  source 1..1847: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4425 - RNA, 1847 nt, synthetic construct
  misc_feature 1..1847: note = mRNA product Design e-5 comprising derived and/or modified sequence from HRSV(A2)__F-del_DSCav1_mut0 (opt5)
  source 1..1847: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4426 - RNA, 1847 nt, synthetic construct
  misc_feature 1..1847: note = mRNA product Design e-5 comprising derived and/or modified sequence from HRSV(A2)__F-del_DSCav1_mut0 (opt6)
  source 1..1847: mol_type = other RNA
gggagagcggctcggccattttgtcccagtcagtccggaggctgcggctgcagaagtaccgcctgcggagtaactgcaaagaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4427 - RNA, 1847 nt, synthetic construct
  misc_feature 1..1847: note = mRNA product Design e-5 comprising derived and/or modified sequence from HRSV(A2)__F-del_DSCav1_mut0 (opt11)
  source 1..1847: mol_type = other RNA
gggagagcggctcggccattttgtcccagtcagtccggaggctgcggctgcagaagtaccgcctgcggagtaactgcaaagaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4428 - RNA, 1914 nt, synthetic construct
  misc_feature 1..1914: note = mRNA product Design e-6 comprising derived and/or modified sequence from HRSV(A2)__F-del_DSCav1_mut0 (opt1)
  source 1..1914: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4429 - RNA, 1914 nt, synthetic construct
  misc_feature 1..1914: note = mRNA product Design e-6 comprising derived and/or modified sequence from HRSV(A2)__F-del_DSCav1_mut0 (opt1)
  source 1..1914: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4430 - RNA, 1914 nt, synthetic construct
  misc_feature 1..1914: note = mRNA product Design e-6 comprising derived and/or modified sequence from HRSV(A2)__F-del_DSCav1_mut0 (opt2)
  source 1..1914: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4431 - RNA, 1914 nt, synthetic construct
  misc_feature 1..1914: note = mRNA product Design e-6 comprising derived and/or modified sequence from HRSV(A2)__F-del_DSCav1_mut0 (opt3)
  source 1..1914: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4432 - RNA, 1914 nt, synthetic construct
  misc_feature 1..1914: note = mRNA product Design e-6 comprising derived and/or modified sequence from HRSV(A2)__F-del_DSCav1_mut0 (opt4)
  source 1..1914: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4433 - RNA, 1914 nt, synthetic construct
  misc_feature 1..1914: note = mRNA product Design e-6 comprising derived and/or modified sequence from HRSV(A2)__F-del_DSCav1_mut0 (opt5)
  source 1..1914: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4434 - RNA, 1914 nt, synthetic construct
  misc_feature 1..1914: note = mRNA product Design e-6 comprising derived and/or modified sequence from HRSV(A2)__F-del_DSCav1_mut0 (opt6)
  source 1..1914: mol_type = other RNA
gggagagcggctcggccattttgtcccagtcagtccggaggctgcggctgcagaagtaccgcctgcggagtaactgcaaagaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4435 - RNA, 1914 nt, synthetic construct
  misc_feature 1..1914: note = mRNA product Design e-6 comprising derived and/or modified sequence from HRSV(A2)__F-del_DSCav1_mut0 (opt11)
  source 1..1914: mol_type = other RNA
gggagagcggctcggccattttgtcccagtcagtccggaggctgcggctgcagaagtaccgcctgcggagtaactgcaaagaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4436 - RNA, 2130 nt, synthetic construct
  misc_feature 1..2130: note = mRNA product Design f-1 comprising derived and/or modified sequence from HRSV(A2)__F-del_DSCav1_mut0 (opt1)
  source 1..2130: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4437 - RNA, 2130 nt, synthetic construct
  misc_feature 1..2130: note = mRNA product Design f-1 comprising derived and/or modified sequence from HRSV(A2)__F-del_DSCav1_mut0 (opt1)
  source 1..2130: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4438 - RNA, 2130 nt, synthetic construct
  misc_feature 1..2130: note = mRNA product Design f-1 comprising derived and/or modified sequence from HRSV(A2)__F-del_DSCav1_mut0 (opt2)
  source 1..2130: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4439 - RNA, 2130 nt, synthetic construct
  misc_feature 1..2130: note = mRNA product Design f-1 comprising derived and/or modified sequence from HRSV(A2)__F-del_DSCav1_mut0 (opt3)
  source 1..2130: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4440 - RNA, 2130 nt, synthetic construct
  misc_feature 1..2130: note = mRNA product Design f-1 comprising derived and/or modified sequence from HRSV(A2)__F-del_DSCav1_mut0 (opt4)
  source 1..2130: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4441 - RNA, 2130 nt, synthetic construct
  misc_feature 1..2130: note = mRNA product Design f-1 comprising derived and/or modified sequence from HRSV(A2)__F-del_DSCav1_mut0 (opt5)
  source 1..2130: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4442 - RNA, 2130 nt, synthetic construct
  misc_feature 1..2130: note = mRNA product Design f-1 comprising derived and/or modified sequence from HRSV(A2)__F-del_DSCav1_mut0 (opt6)
  source 1..2130: mol_type = other RNA
gggagagcggctcggccattttgtcccagtcagtccggaggctgcggctgcagaagtaccgcctgcggagtaactgcaaagaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4443 - RNA, 2130 nt, synthetic construct
  misc_feature 1..2130: note = mRNA product Design f-1 comprising derived and/or modified sequence from HRSV(A2)__F-del_DSCav1_mut0 (opt11)
  source 1..2130: mol_type = other RNA
gggagagcggctcggccattttgtcccagtcagtccggaggctgcggctgcagaagtaccgcctgcggagtaactgcaaagaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4444 - RNA, 1910 nt, synthetic construct
  misc_feature 1..1910: note = mRNA product Design f-2 comprising derived and/or modified sequence from HRSV(A2)__F-del_DSCav1_mut0 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4445 - RNA, 1910 nt, synthetic construct
  misc_feature 1..1910: note = mRNA product Design f-2 comprising derived and/or modified sequence from HRSV(A2)__F-del_DSCav1_mut0 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4446 - RNA, 1910 nt, synthetic construct
  misc_feature 1..1910: note = mRNA product Design f-2 comprising derived and/or modified sequence from HRSV(A2)__F-del_DSCav1_mut0 (opt2)
  source 1..1910: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4447 - RNA, 1910 nt, synthetic construct
  misc_feature 1..1910: note = mRNA product Design f-2 comprising derived and/or modified sequence from HRSV(A2)__F-del_DSCav1_mut0 (opt3)
  source 1..1910: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4448 - RNA, 1910 nt, synthetic construct
  misc_feature 1..1910: note = mRNA product Design f-2 comprising derived and/or modified sequence from HRSV(A2)__F-del_DSCav1_mut0 (opt4)
  source 1..1910: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4449 - RNA, 1910 nt, synthetic construct
  misc_feature 1..1910: note = mRNA product Design f-2 comprising derived and/or modified sequence from HRSV(A2)__F-del_DSCav1_mut0 (opt5)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4450 - RNA, 1910 nt, synthetic construct
  misc_feature 1..1910: note = mRNA product Design f-2 comprising derived and/or modified sequence from HRSV(A2)__F-del_DSCav1_mut0 (opt6)
  source 1..1910: mol_type = other RNA
gggagagcggctcggccattttgtcccagtcagtccggaggctgcggctgcagaagtaccgcctgcggagtaactgcaaagaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4451 - RNA, 1910 nt, synthetic construct
  misc_feature 1..1910: note = mRNA product Design f-2 comprising derived and/or modified sequence from HRSV(A2)__F-del_DSCav1_mut0 (opt11)
  source 1..1910: mol_type = other RNA
gggagagcggctcggccattttgtcccagtcagtccggaggctgcggctgcagaagtaccgcctgcggagtaactgcaaagaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4452 - RNA, 1901 nt, synthetic construct
  misc_feature 1..1901: note = mRNA product Design f-3 comprising derived and/or modified sequence from HRSV(A2)__F-del_DSCav1_mut0 (opt1)
  source 1..1901: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4453 - RNA, 1901 nt, synthetic construct
  misc_feature 1..1901: note = mRNA product Design f-3 comprising derived and/or modified sequence from HRSV(A2)__F-del_DSCav1_mut0 (opt1)
  source 1..1901: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4454 - RNA, 1901 nt, synthetic construct
  misc_feature 1..1901: note = mRNA product Design f-3 comprising derived and/or modified sequence from HRSV(A2)__F-del_DSCav1_mut0 (opt2)
  source 1..1901: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4455 - RNA, 1901 nt, synthetic construct
  misc_feature 1..1901: note = mRNA product Design f-3 comprising derived and/or modified sequence from HRSV(A2)__F-del_DSCav1_mut0 (opt3)
  source 1..1901: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4456 - RNA, 1901 nt, synthetic construct
  misc_feature 1..1901: note = mRNA product Design f-3 comprising derived and/or modified sequence from HRSV(A2)__F-del_DSCav1_mut0 (opt4)
  source 1..1901: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4457 - RNA, 1901 nt, synthetic construct
  misc_feature 1..1901: note = mRNA product Design f-3 comprising derived and/or modified sequence from HRSV(A2)__F-del_DSCav1_mut0 (opt5)
  source 1..1901: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4458 - RNA, 1901 nt, synthetic construct
  misc_feature 1..1901: note = mRNA product Design f-3 comprising derived and/or modified sequence from HRSV(A2)__F-del_DSCav1_mut0 (opt6)
  source 1..1901: mol_type = other RNA
gggagagtcccgcagtcggcgtccagcggctctgcttgttcgtgtgtgtgtcgttgcaggccttattcaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4459 - RNA, 1901 nt, synthetic construct
  misc_feature 1..1901: note = mRNA product Design f-3 comprising derived and/or modified sequence from HRSV(A2)__F-del_DSCav1_mut0 (opt11)
  source 1..1901: mol_type = other RNA
gggagagtcccgcagtcggcgtccagcggctctgcttgttcgtgtgtgtgtcgttgcaggccttattcaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4460 - RNA, 2117 nt, synthetic construct
  misc_feature 1..2117: note = mRNA product Design f-4 comprising derived and/or modified sequence from HRSV(A2)__F-del_DSCav1_mut0 (opt1)
  source 1..2117: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4461 - RNA, 2117 nt, synthetic construct
  misc_feature 1..2117: note = mRNA product Design f-4 comprising derived and/or modified sequence from HRSV(A2)__F-del_DSCav1_mut0 (opt1)
  source 1..2117: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4462 - RNA, 2117 nt, synthetic construct
  misc_feature 1..2117: note = mRNA product Design f-4 comprising derived and/or modified sequence from HRSV(A2)__F-del_DSCav1_mut0 (opt2)
  source 1..2117: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4463 - RNA, 2117 nt, synthetic construct
  misc_feature 1..2117: note = mRNA product Design f-4 comprising derived and/or modified sequence from HRSV(A2)__F-del_DSCav1_mut0 (opt3)
  source 1..2117: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4464 - RNA, 2117 nt, synthetic construct
  misc_feature 1..2117: note = mRNA product Design f-4 comprising derived and/or modified sequence from HRSV(A2)__F-del_DSCav1_mut0 (opt4)
  source 1..2117: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4465 - RNA, 2117 nt, synthetic construct
  misc_feature 1..2117: note = mRNA product Design f-4 comprising derived and/or modified sequence from HRSV(A2)__F-del_DSCav1_mut0 (opt5)
  source 1..2117: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4466 - RNA, 2117 nt, synthetic construct
  misc_feature 1..2117: note = mRNA product Design f-4 comprising derived and/or modified sequence from HRSV(A2)__F-del_DSCav1_mut0 (opt6)
  source 1..2117: mol_type = other RNA
gggagagtcccgcagtcggcgtccagcggctctgcttgttcgtgtgtgtgtcgttgcaggccttattcaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4467 - RNA, 2117 nt, synthetic construct
  misc_feature 1..2117: note = mRNA product Design f-4 comprising derived and/or modified sequence from HRSV(A2)__F-del_DSCav1_mut0 (opt11)
  source 1..2117: mol_type = other RNA
gggagagtcccgcagtcggcgtccagcggctctgcttgttcgtgtgtgtgtcgttgcaggccttattcaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4468 - RNA, 1893 nt, synthetic construct
  misc_feature 1..1893: note = mRNA product Design f-5 comprising derived and/or modified sequence from HRSV(A2)__F-del_DSCav1_mut0 (opt1)
  source 1..1893: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4469 - RNA, 1893 nt, synthetic construct
  misc_feature 1..1893: note = mRNA product Design f-5 comprising derived and/or modified sequence from HRSV(A2)__F-del_DSCav1_mut0 (opt1)
  source 1..1893: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4470 - RNA, 1893 nt, synthetic construct
  misc_feature 1..1893: note = mRNA product Design f-5 comprising derived and/or modified sequence from HRSV(A2)__F-del_DSCav1_mut0 (opt2)
  source 1..1893: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4471 - RNA, 1893 nt, synthetic construct
  misc_feature 1..1893: note = mRNA product Design f-5 comprising derived and/or modified sequence from HRSV(A2)__F-del_DSCav1_mut0 (opt3)
  source 1..1893: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4472 - RNA, 1893 nt, synthetic construct
  misc_feature 1..1893: note = mRNA product Design f-5 comprising derived and/or modified sequence from HRSV(A2)__F-del_DSCav1_mut0 (opt4)
  source 1..1893: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4473 - RNA, 1893 nt, synthetic construct
  misc_feature 1..1893: note = mRNA product Design f-5 comprising derived and/or modified sequence from HRSV(A2)__F-del_DSCav1_mut0 (opt5)
  source 1..1893: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4474 - RNA, 1893 nt, synthetic construct
  misc_feature 1..1893: note = mRNA product Design f-5 comprising derived and/or modified sequence from HRSV(A2)__F-del_DSCav1_mut0 (opt6)
  source 1..1893: mol_type = other RNA
gggagactttcccattctgtagcagaatttggtgttgcctgtggtcttggtcccgcggagaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4475 - RNA, 1893 nt, synthetic construct
  misc_feature 1..1893: note = mRNA product Design f-5 comprising derived and/or modified sequence from HRSV(A2)__F-del_DSCav1_mut0 (opt11)
  source 1..1893: mol_type = other RNA
gggagactttcccattctgtagcagaatttggtgttgcctgtggtcttggtcccgcggagaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4476 - RNA, 1889 nt, synthetic construct
  misc_feature 1..1889: note = mRNA product Design g-1 comprising derived and/or modified sequence from HRSV(A2)__F-del_DSCav1_mut0 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4477 - RNA, 1889 nt, synthetic construct
  misc_feature 1..1889: note = mRNA product Design g-1 comprising derived and/or modified sequence from HRSV(A2)__F-del_DSCav1_mut0 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4478 - RNA, 1889 nt, synthetic construct
  misc_feature 1..1889: note = mRNA product Design g-1 comprising derived and/or modified sequence from HRSV(A2)__F-del_DSCav1_mut0 (opt2)
  source 1..1889: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4479 - RNA, 1889 nt, synthetic construct
  misc_feature 1..1889: note = mRNA product Design g-1 comprising derived and/or modified sequence from HRSV(A2)__F-del_DSCav1_mut0 (opt3)
  source 1..1889: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4480 - RNA, 1889 nt, synthetic construct
  misc_feature 1..1889: note = mRNA product Design g-1 comprising derived and/or modified sequence from HRSV(A2)__F-del_DSCav1_mut0 (opt4)
  source 1..1889: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4481 - RNA, 1889 nt, synthetic construct
  misc_feature 1..1889: note = mRNA product Design g-1 comprising derived and/or modified sequence from HRSV(A2)__F-del_DSCav1_mut0 (opt5)
  source 1..1889: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4482 - RNA, 1889 nt, synthetic construct
  misc_feature 1..1889: note = mRNA product Design g-1 comprising derived and/or modified sequence from HRSV(A2)__F-del_DSCav1_mut0 (opt6)
  source 1..1889: mol_type = other RNA
gggagactttcccattctgtagcagaatttggtgttgcctgtggtcttggtcccgcggagaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4483 - RNA, 1889 nt, synthetic construct
  misc_feature 1..1889: note = mRNA product Design g-1 comprising derived and/or modified sequence from HRSV(A2)__F-del_DSCav1_mut0 (opt11)
  source 1..1889: mol_type = other RNA
gggagactttcccattctgtagcagaatttggtgttgcctgtggtcttggtcccgcggagaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4484 - RNA, 1904 nt, synthetic construct
  misc_feature 1..1904: note = mRNA product Design g-2 comprising derived and/or modified sequence from HRSV(A2)__F-del_DSCav1_mut0 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4485 - RNA, 1904 nt, synthetic construct
  misc_feature 1..1904: note = mRNA product Design g-2 comprising derived and/or modified sequence from HRSV(A2)__F-del_DSCav1_mut0 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4486 - RNA, 1904 nt, synthetic construct
  misc_feature 1..1904: note = mRNA product Design g-2 comprising derived and/or modified sequence from HRSV(A2)__F-del_DSCav1_mut0 (opt2)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4487 - RNA, 1904 nt, synthetic construct
  misc_feature 1..1904: note = mRNA product Design g-2 comprising derived and/or modified sequence from HRSV(A2)__F-del_DSCav1_mut0 (opt3)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4488 - RNA, 1904 nt, synthetic construct
  misc_feature 1..1904: note = mRNA product Design g-2 comprising derived and/or modified sequence from HRSV(A2)__F-del_DSCav1_mut0 (opt4)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4489 - RNA, 1904 nt, synthetic construct
  misc_feature 1..1904: note = mRNA product Design g-2 comprising derived and/or modified sequence from HRSV(A2)__F-del_DSCav1_mut0 (opt5)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4490 - RNA, 1904 nt, synthetic construct
  misc_feature 1..1904: note = mRNA product Design g-2 comprising derived and/or modified sequence from HRSV(A2)__F-del_DSCav1_mut0 (opt6)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4491 - RNA, 1904 nt, synthetic construct
  misc_feature 1..1904: note = mRNA product Design g-2 comprising derived and/or modified sequence from HRSV(A2)__F-del_DSCav1_mut0 (opt11)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4492 - RNA, 2136 nt, synthetic construct
  misc_feature 1..2136: note = mRNA product Design g-3 comprising derived and/or modified sequence from HRSV(A2)__F-del_DSCav1_mut0 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4493 - RNA, 2136 nt, synthetic construct
  misc_feature 1..2136: note = mRNA product Design g-3 comprising derived and/or modified sequence from HRSV(A2)__F-del_DSCav1_mut0 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4494 - RNA, 2136 nt, synthetic construct
  misc_feature 1..2136: note = mRNA product Design g-3 comprising derived and/or modified sequence from HRSV(A2)__F-del_DSCav1_mut0 (opt2)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4495 - RNA, 2136 nt, synthetic construct
  misc_feature 1..2136: note = mRNA product Design g-3 comprising derived and/or modified sequence from HRSV(A2)__F-del_DSCav1_mut0 (opt3)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4496 - RNA, 2136 nt, synthetic construct
  misc_feature 1..2136: note = mRNA product Design g-3 comprising derived and/or modified sequence from HRSV(A2)__F-del_DSCav1_mut0 (opt4)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4497 - RNA, 2136 nt, synthetic construct
  misc_feature 1..2136: note = mRNA product Design g-3 comprising derived and/or modified sequence from HRSV(A2)__F-del_DSCav1_mut0 (opt5)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4498 - RNA, 2136 nt, synthetic construct
  misc_feature 1..2136: note = mRNA product Design g-3 comprising derived and/or modified sequence from HRSV(A2)__F-del_DSCav1_mut0 (opt6)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4499 - RNA, 2136 nt, synthetic construct
  misc_feature 1..2136: note = mRNA product Design g-3 comprising derived and/or modified sequence from HRSV(A2)__F-del_DSCav1_mut0 (opt11)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4500 - RNA, 1931 nt, synthetic construct
  misc_feature 1..1931: note = mRNA product Design g-4 comprising derived and/or modified sequence from HRSV(A2)__F-del_DSCav1_mut0 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4501 - RNA, 1931 nt, synthetic construct
  misc_feature 1..1931: note = mRNA product Design g-4 comprising derived and/or modified sequence from HRSV(A2)__F-del_DSCav1_mut0 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4502 - RNA, 1931 nt, synthetic construct
  misc_feature 1..1931: note = mRNA product Design g-4 comprising derived and/or modified sequence from HRSV(A2)__F-del_DSCav1_mut0 (opt2)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4503 - RNA, 1931 nt, synthetic construct
  misc_feature 1..1931: note = mRNA product Design g-4 comprising derived and/or modified sequence from HRSV(A2)__F-del_DSCav1_mut0 (opt3)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4504 - RNA, 1931 nt, synthetic construct
  misc_feature 1..1931: note = mRNA product Design g-4 comprising derived and/or modified sequence from HRSV(A2)__F-del_DSCav1_mut0 (opt4)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4505 - RNA, 1931 nt, synthetic construct
  misc_feature 1..1931: note = mRNA product Design g-4 comprising derived and/or modified sequence from HRSV(A2)__F-del_DSCav1_mut0 (opt5)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4506 - RNA, 1931 nt, synthetic construct
  misc_feature 1..1931: note = mRNA product Design g-4 comprising derived and/or modified sequence from HRSV(A2)__F-del_DSCav1_mut0 (opt6)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4507 - RNA, 1931 nt, synthetic construct
  misc_feature 1..1931: note = mRNA product Design g-4 comprising derived and/or modified sequence from HRSV(A2)__F-del_DSCav1_mut0 (opt11)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4508 - RNA, 1907 nt, synthetic construct
  misc_feature 1..1907: note = mRNA product Design g-5 comprising derived and/or modified sequence from HRSV(A2)__F-del_DSCav1_mut0 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4509 - RNA, 1907 nt, synthetic construct
  misc_feature 1..1907: note = mRNA product Design g-5 comprising derived and/or modified sequence from HRSV(A2)__F-del_DSCav1_mut0 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4510 - RNA, 1907 nt, synthetic construct
  misc_feature 1..1907: note = mRNA product Design g-5 comprising derived and/or modified sequence from HRSV(A2)__F-del_DSCav1_mut0 (opt2)
  source 1..1907: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4511 - RNA, 1907 nt, synthetic construct
  misc_feature 1..1907: note = mRNA product Design g-5 comprising derived and/or modified sequence from HRSV(A2)__F-del_DSCav1_mut0 (opt3)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4512 - RNA, 1907 nt, synthetic construct
  misc_feature 1..1907: note = mRNA product Design g-5 comprising derived and/or modified sequence from HRSV(A2)__F-del_DSCav1_mut0 (opt4)
  source 1..1907: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4513 - RNA, 1907 nt, synthetic construct
  misc_feature 1..1907: note = mRNA product Design g-5 comprising derived and/or modified sequence from HRSV(A2)__F-del_DSCav1_mut0 (opt5)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4514 - RNA, 1907 nt, synthetic construct
  misc_feature 1..1907: note = mRNA product Design g-5 comprising derived and/or modified sequence from HRSV(A2)__F-del_DSCav1_mut0 (opt6)
  source 1..1907: mol_type = other RNA
gggagacccgtgacccggaagttgtacggctacgcgactttccctcccacaaaccctcgcgcccttcctttcctacttgggcccggcagaaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4515 - RNA, 1907 nt, synthetic construct
  misc_feature 1..1907: note = mRNA product Design g-5 comprising derived and/or modified sequence from HRSV(A2)__F-del_DSCav1_mut0 (opt11)
  source 1..1907: mol_type = other RNA
gggagacccgtgacccggaagttgtacggctacgcgactttccctcccacaaaccctcgcgcccttcctttcctacttgggcccggcagaaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4516 - RNA, 1923 nt, synthetic construct
  misc_feature 1..1923: note = mRNA product Design h-1 comprising derived and/or modified sequence from HRSV(A2)__F-del_DSCav1_mut0 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4517 - RNA, 1923 nt, synthetic construct
  misc_feature 1..1923: note = mRNA product Design h-1 comprising derived and/or modified sequence from HRSV(A2)__F-del_DSCav1_mut0 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4518 - RNA, 1923 nt, synthetic construct
  misc_feature 1..1923: note = mRNA product Design h-1 comprising derived and/or modified sequence from HRSV(A2)__F-del_DSCav1_mut0 (opt2)
  source 1..1923: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4519 - RNA, 1923 nt, synthetic construct
  misc_feature 1..1923: note = mRNA product Design h-1 comprising derived and/or modified sequence from HRSV(A2)__F-del_DSCav1_mut0 (opt3)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4520 - RNA, 1923 nt, synthetic construct
  misc_feature 1..1923: note = mRNA product Design h-1 comprising derived and/or modified sequence from HRSV(A2)__F-del_DSCav1_mut0 (opt4)
  source 1..1923: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4521 - RNA, 1923 nt, synthetic construct
  misc_feature 1..1923: note = mRNA product Design h-1 comprising derived and/or modified sequence from HRSV(A2)__F-del_DSCav1_mut0 (opt5)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4522 - RNA, 1923 nt, synthetic construct
  misc_feature 1..1923: note = mRNA product Design h-1 comprising derived and/or modified sequence from HRSV(A2)__F-del_DSCav1_mut0 (opt6)
  source 1..1923: mol_type = other RNA
gggagacccgtgacccggaagttgtacggctacgcgactttccctcccacaaaccctcgcgcccttcctttcctacttgggcccggcagaaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4523 - RNA, 1923 nt, synthetic construct
  misc_feature 1..1923: note = mRNA product Design h-1 comprising derived and/or modified sequence from HRSV(A2)__F-del_DSCav1_mut0 (opt11)
  source 1..1923: mol_type = other RNA
gggagacccgtgacccggaagttgtacggctacgcgactttccctcccacaaaccctcgcgcccttcctttcctacttgggcccggcagaaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4524 - RNA, 2139 nt, synthetic construct
  misc_feature 1..2139: note = mRNA product Design h-2 comprising derived and/or modified sequence from HRSV(A2)__F-del_DSCav1_mut0 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4525 - RNA, 2139 nt, synthetic construct
  misc_feature 1..2139: note = mRNA product Design h-2 comprising derived and/or modified sequence from HRSV(A2)__F-del_DSCav1_mut0 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4526 - RNA, 2139 nt, synthetic construct
  misc_feature 1..2139: note = mRNA product Design h-2 comprising derived and/or modified sequence from HRSV(A2)__F-del_DSCav1_mut0 (opt2)
  source 1..2139: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4527 - RNA, 2139 nt, synthetic construct
  misc_feature 1..2139: note = mRNA product Design h-2 comprising derived and/or modified sequence from HRSV(A2)__F-del_DSCav1_mut0 (opt3)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4528 - RNA, 2139 nt, synthetic construct
  misc_feature 1..2139: note = mRNA product Design h-2 comprising derived and/or modified sequence from HRSV(A2)__F-del_DSCav1_mut0 (opt4)
  source 1..2139: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4529 - RNA, 2139 nt, synthetic construct
  misc_feature 1..2139: note = mRNA product Design h-2 comprising derived and/or modified sequence from HRSV(A2)__F-del_DSCav1_mut0 (opt5)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4530 - RNA, 2139 nt, synthetic construct
  misc_feature 1..2139: note = mRNA product Design h-2 comprising derived and/or modified sequence from HRSV(A2)__F-del_DSCav1_mut0 (opt6)
  source 1..2139: mol_type = other RNA
gggagacccgtgacccggaagttgtacggctacgcgactttccctcccacaaaccctcgcgcccttcctttcctacttgggcccggcagaaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4531 - RNA, 2139 nt, synthetic construct
  misc_feature 1..2139: note = mRNA product Design h-2 comprising derived and/or modified sequence from HRSV(A2)__F-del_DSCav1_mut0 (opt11)
  source 1..2139: mol_type = other RNA
gggagacccgtgacccggaagttgtacggctacgcgactttccctcccacaaaccctcgcgcccttcctttcctacttgggcccggcagaaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4532 - RNA, 1919 nt, synthetic construct
  misc_feature 1..1919: note = mRNA product Design h-3 comprising derived and/or modified sequence from HRSV(A2)__F-del_DSCav1_mut0 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4533 - RNA, 1919 nt, synthetic construct
  misc_feature 1..1919: note = mRNA product Design h-3 comprising derived and/or modified sequence from HRSV(A2)__F-del_DSCav1_mut0 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4534 - RNA, 1919 nt, synthetic construct
  misc_feature 1..1919: note = mRNA product Design h-3 comprising derived and/or modified sequence from HRSV(A2)__F-del_DSCav1_mut0 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4535 - RNA, 1919 nt, synthetic construct
  misc_feature 1..1919: note = mRNA product Design h-3 comprising derived and/or modified sequence from HRSV(A2)__F-del_DSCav1_mut0 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4536 - RNA, 1919 nt, synthetic construct
  misc_feature 1..1919: note = mRNA product Design h-3 comprising derived and/or modified sequence from HRSV(A2)__F-del_DSCav1_mut0 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4537 - RNA, 1919 nt, synthetic construct
  misc_feature 1..1919: note = mRNA product Design h-3 comprising derived and/or modified sequence from HRSV(A2)__F-del_DSCav1_mut0 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4538 - RNA, 1919 nt, synthetic construct
  misc_feature 1..1919: note = mRNA product Design h-3 comprising derived and/or modified sequence from HRSV(A2)__F-del_DSCav1_mut0 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4539 - RNA, 1919 nt, synthetic construct
  misc_feature 1..1919: note = mRNA product Design h-3 comprising derived and/or modified sequence from HRSV(A2)__F-del_DSCav1_mut0 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4540 - RNA, 1982 nt, synthetic construct
  misc_feature 1..1982: note = mRNA product Design h-4 comprising derived and/or modified sequence from HRSV(A2)__F-del_DSCav1_mut0 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4541 - RNA, 1982 nt, synthetic construct
  misc_feature 1..1982: note = mRNA product Design h-4 comprising derived and/or modified sequence from HRSV(A2)__F-del_DSCav1_mut0 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4542 - RNA, 1982 nt, synthetic construct
  misc_feature 1..1982: note = mRNA product Design h-4 comprising derived and/or modified sequence from HRSV(A2)__F-del_DSCav1_mut0 (opt2)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4543 - RNA, 1982 nt, synthetic construct
  misc_feature 1..1982: note = mRNA product Design h-4 comprising derived and/or modified sequence from HRSV(A2)__F-del_DSCav1_mut0 (opt3)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4544 - RNA, 1982 nt, synthetic construct
  misc_feature 1..1982: note = mRNA product Design h-4 comprising derived and/or modified sequence from HRSV(A2)__F-del_DSCav1_mut0 (opt4)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4545 - RNA, 1982 nt, synthetic construct
  misc_feature 1..1982: note = mRNA product Design h-4 comprising derived and/or modified sequence from HRSV(A2)__F-del_DSCav1_mut0 (opt5)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4546 - RNA, 1982 nt, synthetic construct
  misc_feature 1..1982: note = mRNA product Design h-4 comprising derived and/or modified sequence from HRSV(A2)__F-del_DSCav1_mut0 (opt6)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4547 - RNA, 1982 nt, synthetic construct
  misc_feature 1..1982: note = mRNA product Design h-4 comprising derived and/or modified sequence from HRSV(A2)__F-del_DSCav1_mut0 (opt11)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4548 - RNA, 1998 nt, synthetic construct
  misc_feature 1..1998: note = mRNA product Design h-5 comprising derived and/or modified sequence from HRSV(A2)__F-del_DSCav1_mut0 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4549 - RNA, 1998 nt, synthetic construct
  misc_feature 1..1998: note = mRNA product Design h-5 comprising derived and/or modified sequence from HRSV(A2)__F-del_DSCav1_mut0 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4550 - RNA, 1998 nt, synthetic construct
  misc_feature 1..1998: note = mRNA product Design h-5 comprising derived and/or modified sequence from HRSV(A2)__F-del_DSCav1_mut0 (opt2)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4551 - RNA, 1998 nt, synthetic construct
  misc_feature 1..1998: note = mRNA product Design h-5 comprising derived and/or modified sequence from HRSV(A2)__F-del_DSCav1_mut0 (opt3)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4552 - RNA, 1998 nt, synthetic construct
  misc_feature 1..1998: note = mRNA product Design h-5 comprising derived and/or modified sequence from HRSV(A2)__F-del_DSCav1_mut0 (opt4)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4553 - RNA, 1998 nt, synthetic construct
  misc_feature 1..1998: note = mRNA product Design h-5 comprising derived and/or modified sequence from HRSV(A2)__F-del_DSCav1_mut0 (opt5)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4554 - RNA, 1998 nt, synthetic construct
  misc_feature 1..1998: note = mRNA product Design h-5 comprising derived and/or modified sequence from HRSV(A2)__F-del_DSCav1_mut0 (opt6)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4555 - RNA, 1998 nt, synthetic construct
  misc_feature 1..1998: note = mRNA product Design h-5 comprising derived and/or modified sequence from HRSV(A2)__F-del_DSCav1_mut0 (opt11)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4556 - RNA, 1931 nt, synthetic construct
  misc_feature 1..1931: note = mRNA product Design i-1 comprising derived and/or modified sequence from HRSV(A2)__F-del_DSCav1_mut0 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4557 - RNA, 1931 nt, synthetic construct
  misc_feature 1..1931: note = mRNA product Design i-1 comprising derived and/or modified sequence from HRSV(A2)__F-del_DSCav1_mut0 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4558 - RNA, 1931 nt, synthetic construct
  misc_feature 1..1931: note = mRNA product Design i-1 comprising derived and/or modified sequence from HRSV(A2)__F-del_DSCav1_mut0 (opt2)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4559 - RNA, 1931 nt, synthetic construct
  misc_feature 1..1931: note = mRNA product Design i-1 comprising derived and/or modified sequence from HRSV(A2)__F-del_DSCav1_mut0 (opt3)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4560 - RNA, 1931 nt, synthetic construct
  misc_feature 1..1931: note = mRNA product Design i-1 comprising derived and/or modified sequence from HRSV(A2)__F-del_DSCav1_mut0 (opt4)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4561 - RNA, 1931 nt, synthetic construct
  misc_feature 1..1931: note = mRNA product Design i-1 comprising derived and/or modified sequence from HRSV(A2)__F-del_DSCav1_mut0 (opt5)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4562 - RNA, 1931 nt, synthetic construct
  misc_feature 1..1931: note = mRNA product Design i-1 comprising derived and/or modified sequence from HRSV(A2)__F-del_DSCav1_mut0 (opt6)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4563 - RNA, 1931 nt, synthetic construct
  misc_feature 1..1931: note = mRNA product Design i-1 comprising derived and/or modified sequence from HRSV(A2)__F-del_DSCav1_mut0 (opt11)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4564 - RNA, 1931 nt, synthetic construct
  misc_feature 1..1931: note = mRNA product Design i-2 comprising derived and/or modified sequence from HRSV(A2)__F-del_DSCav1_mut0 (opt1)
  source 1..1931: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4565 - RNA, 1931 nt, synthetic construct
  misc_feature 1..1931: note = mRNA product Design i-2 comprising derived and/or modified sequence from HRSV(A2)__F-del_DSCav1_mut0 (opt1)
  source 1..1931: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4566 - RNA, 1931 nt, synthetic construct
  misc_feature 1..1931: note = mRNA product Design i-2 comprising derived and/or modified sequence from HRSV(A2)__F-del_DSCav1_mut0 (opt2)
  source 1..1931: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4567 - RNA, 1931 nt, synthetic construct
  misc_feature 1..1931: note = mRNA product Design i-2 comprising derived and/or modified sequence from HRSV(A2)__F-del_DSCav1_mut0 (opt3)
  source 1..1931: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4568 - RNA, 1931 nt, synthetic construct
  misc_feature 1..1931: note = mRNA product Design i-2 comprising derived and/or modified sequence from HRSV(A2)__F-del_DSCav1_mut0 (opt4)
  source 1..1931: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4569 - RNA, 1931 nt, synthetic construct
  misc_feature 1..1931: note = mRNA product Design i-2 comprising derived and/or modified sequence from HRSV(A2)__F-del_DSCav1_mut0 (opt5)
  source 1..1931: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4570 - RNA, 1931 nt, synthetic construct
  misc_feature 1..1931: note = mRNA product Design i-2 comprising derived and/or modified sequence from HRSV(A2)__F-del_DSCav1_mut0 (opt6)
  source 1..1931: mol_type = other RNA
gggagaggcgctgcctacggaggtggcagccatctccttctcggcatcaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4571 - RNA, 1931 nt, synthetic construct
  misc_feature 1..1931: note = mRNA product Design i-2 comprising derived and/or modified sequence from HRSV(A2)__F-del_DSCav1_mut0 (opt11)
  source 1..1931: mol_type = other RNA
gggagaggcgctgcctacggaggtggcagccatctccttctcggcatcaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4572 - RNA, 1927 nt, synthetic construct
  misc_feature 1..1927: note = mRNA product Design i-2 comprising derived and/or modified sequence from HRSV(A2)__F-del_DSCav1_mut0 (opt1)
  source 1..1927: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4573 - RNA, 1927 nt, synthetic construct
  misc_feature 1..1927: note = mRNA product Design i-2 comprising derived and/or modified sequence from HRSV(A2)__F-del_DSCav1_mut0 (opt1)
  source 1..1927: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4574 - RNA, 1927 nt, synthetic construct
  misc_feature 1..1927: note = mRNA product Design i-2 comprising derived and/or modified sequence from HRSV(A2)__F-del_DSCav1_mut0 (opt2)
  source 1..1927: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4575 - RNA, 1927 nt, synthetic construct
  misc_feature 1..1927: note = mRNA product Design i-2 comprising derived and/or modified sequence from HRSV(A2)__F-del_DSCav1_mut0 (opt3)
  source 1..1927: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4576 - RNA, 1927 nt, synthetic construct
  misc_feature 1..1927: note = mRNA product Design i-2 comprising derived and/or modified sequence from HRSV(A2)__F-del_DSCav1_mut0 (opt4)
  source 1..1927: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4577 - RNA, 1927 nt, synthetic construct
  misc_feature 1..1927: note = mRNA product Design i-2 comprising derived and/or modified sequence from HRSV(A2)__F-del_DSCav1_mut0 (opt5)
  source 1..1927: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4578 - RNA, 1927 nt, synthetic construct
  misc_feature 1..1927: note = mRNA product Design i-2 comprising derived and/or modified sequence from HRSV(A2)__F-del_DSCav1_mut0 (opt6)
  source 1..1927: mol_type = other RNA
ggggcgctgcctacggaggtggcagccatctccttctcggcatcaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4579 - RNA, 1927 nt, synthetic construct
  misc_feature 1..1927: note = mRNA product Design i-2 comprising derived and/or modified sequence from HRSV(A2)__F-del_DSCav1_mut0 (opt11)
  source 1..1927: mol_type = other RNA
ggggcgctgcctacggaggtggcagccatctccttctcggcatcaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4580 - RNA, 1762 nt, synthetic construct
  misc_feature 1..1762: note = mRNA product Design i-3 comprising derived and/or modified sequence from HRSV(A2)__F-del_DSCav1_mut0 (opt1) R7455
  source 1..1762: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4581 - RNA, 1762 nt, synthetic construct
  misc_feature 1..1762: note = mRNA product Design i-3 comprising derived and/or modified sequence from HRSV(A2)__F-del_DSCav1_mut0 (opt1)
  source 1..1762: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4582 - RNA, 1762 nt, synthetic construct
  misc_feature 1..1762: note = mRNA product Design i-3 comprising derived and/or modified sequence from HRSV(A2)__F-del_DSCav1_mut0 (opt2)
  source 1..1762: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4583 - RNA, 1762 nt, synthetic construct
  misc_feature 1..1762: note = mRNA product Design i-3 comprising derived and/or modified sequence from HRSV(A2)__F-del_DSCav1_mut0 (opt3)
  source 1..1762: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcaacggtgtgtccgtattaacttttaaggttctggaccttaagaattacattgataaacaattgctgcctatcctaaacaagcagtcatgcagtattagcaatatcgagaccgtgatagagttccagcagaaaaacaataggctcctggaaattacacgggagttttctgtcaacgcgggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgtattataaaggaggaagtgttagcatatgtagtgcaactgcccctctacggagtcatcgacactccttgctggaaacttcatacaagcccactgtgtaccactaatacaaaggagggctcgaacatttgcttgacccgaacggatcgtggctggtactgtgacaatgccgggtctgtgtccttctttccccaggctgaaacctgcaaggttcagtcaaacagagtgttctgtgatacaatgaatagtagaactctgcctagcgaggtcaacctctgcaatgtggacatctttaacccaaaatatgattgcaagataatgacctccaaaacagacgtatctagctcagttattaccagtctgggagccatcgtgtcctgttacggtaagactaaatgcacagcaagcaataagaacaggggcatcattaagaccttctctaatgggtgtgattatgtctcaaacaaaggagtggacactgtcagtgtgggcaatacgctttactatgttaacaagcaagagggtaaaagcctgtacgtgaagggggaacccatcattaacttttatgaccctttggtattcccatccgatgagtttgacgcttctatatcgcaggtcaatgagaaaatcaaccagagcctcgccttcattcggaagtccgatgaactgttacacaatgtgaacgcgggaaagtcaacaaccaatatcatgatcactaccattataatcgttattatcgtgattctgctaagtctcatcgccgtcggcctgcttttgtactgcaaagcacgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4584 - RNA, 1762 nt, synthetic construct
  misc_feature 1..1762: note = mRNA product Design i-3 comprising derived and/or modified sequence from HRSV(A2)__F-del_DSCav1_mut0 (opt4)
  source 1..1762: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4585 - RNA, 1762 nt, synthetic construct
  misc_feature 1..1762: note = mRNA product Design i-3 comprising derived and/or modified sequence from HRSV(A2)__F-del_DSCav1_mut0 (opt5)
  source 1..1762: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcaacggagtttctgtgctgacatttaaggtccttgacctgaagaattacattgataaacaactcctgcctatcctgaacaagcagtcctgcagcatttctaatatcgagaccgtgattgagttccagcagaaaaacaatcggctcctggaaatcacgcgcgagttttccgtgaacgccggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgtatcattaaggaggaagtcctggcttatgtggttcaactccctctgtacggcgtgatcgacacaccctgctggaaactgcatacgtctcctctctgtaccacaaataccaaggaggggtccaacatctgcctgacacggaccgatcgcggatggtactgtgacaatgccggcagcgtctctttctttccccaggcggaaacgtgcaaggtgcagagcaacagagttttctgtgatacaatgaactccagaaccctgccttctgaggtgaatctctgcaatgtcgacatttttaacccgaaatatgattgcaagatcatgaccagcaaaacagacgtgtccagctctgtcattacctccctgggggccatcgtgagctgttacggaaagacaaaatgcacggcttctaataagaaccggggcattatcaagaccttctccaatgggtgtgattatgttagcaacaaaggagtggacacagtctccgtgggcaataccctttactatgttaacaagcaagagggcaaatctctgtacgtgaagggggaacccatcattaacttttatgaccctctcgtcttccccagcgatgagtttgacgcctccatctctcaggtgaatgagaaaattaaccagagcctggctttcatccgcaagtccgatgaactgctccacaatgtgaacgccggaaagagcacaaccaatattatgatcacgaccattatcatcgttattatcgtcattctgctttctctgatcgccgtgggcctcctgctgtactgcaaagctagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4586 - RNA, 1762 nt, synthetic construct
  misc_feature 1..1762: note = mRNA product Design i-3 comprising derived and/or modified sequence from HRSV(A2)__F-del_DSCav1_mut0 (opt6)
  source 1..1762: mol_type = other RNA
gggagaaagcttaccatggaattactcatcctcaaagcaaacgcaataacaacaatactaacagcagtcactttctgcttcgcatccggacaaaatatcacagaagaattttaccaatccacctgctctgctgtctccaaaggatacctatctgccctcagaaccggttggtatacatctgtcataaccatagaactatcaaacattaaagaaaacaaatgtaacggaacagacgcaaaagtcaaacttataaaacaagaattagacaaatacaaaaacgcagtcacagaattacaactactaatgcaatcaaccccagcaaccggatcaggatccgcaatagcttcaggagtagcagtatgtaaagttctacacttagaaggagaagtcaacaaaattaaatccgcactattatcaaccaacaaagcagtcgtatctttatcaaacggagtatctgtacttacattcaaagtactagacctaaaaaattacattgataaacaattactaccaatactaaacaaacaatcatgttccatctctaacatagaaacagtaatagaatttcaacaaaaaaataacagattacttgaaatcacccgagaattttcagtaaacgcaggagtaaccacacccgtatctacatacatgctaacaaactctgaacttctgagcctaataaatgacatgccaataaccaacgaccaaaaaaaactaatgtccaacaacgtacaaatagtacgacaacaatcttactcaatcatgtgcataatcaaagaagaagtactagcttatgtagtccaacttccactctacggagtaatagacaccccctgctggaaactacacacatcaccactatgcacaacaaacacaaaagaaggctcaaacatatgcctaacaagaactgacagaggatggtattgtgacaatgcaggctctgtctcattctttccacaagccgaaacatgcaaagttcaatcaaaccgagttttctgtgacacaatgaactctagaactctcccatcagaagtcaacttatgcaacgttgacatattcaacccaaaatatgactgtaaaataatgacttccaaaactgatgtatcatcctccgtcataacatccctaggagctattgtatcatgttacgggaaaaccaaatgcacagcctcaaacaaaaaccgcggtatcataaaaacattttcaaacggatgtgattacgtaagcaataaaggagtagacaccgtatcagtaggaaatacactatactatgtaaataaacaagaaggaaaatcactatatgtcaaaggagaaccaatcataaatttctatgacccacttgtattcccatccgatgaatttgacgcaagcatttcacaggtcaacgaaaaaataaaccaatcactagccttcatcagaaaatcagacgaactactacataacgtaaacgccggaaaatcaacaaccaacataatgataacaacaatcataatagttatcatagtaatactactatctctaatagctgtcggactcttactatattgcaaagcccgataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4587 - RNA, 1762 nt, synthetic construct
  misc_feature 1..1762: note = mRNA product Design i-3 comprising derived and/or modified sequence from HRSV(A2)__F-del_DSCav1_mut0 (opt11)
  source 1..1762: mol_type = other RNA
gggagaaagcttaccatggaactactaatcctgaaagccaacgccataaccacaatccttaccgcagtcaccttctgcttcgcctccggtcaaaacatcacagaagagttctaccaatccacctgttccgcagtcagcaaaggctacctctccgcactccgaaccggatggtacaccagcgtcatcaccatcgaactatccaacataaaggaaaataagtgcaatggtacagatgccaaggtcaaactcataaagcaagaactcgacaaatacaaaaacgccgtcaccgaactacaactactaatgcaatctacccccgcaacaggctcaggttccgccatagcctccggcgtcgccgtttgcaaagtcctccacctcgaaggcgaagtaaacaaaatcaaatccgccctactctcaaccaacaaagcagtcgtctccctctcaaacggagtctcggtcctcaccttcaaagtcctcgacctcaaaaactatatagacaaacaactcctacccatactcaacaaacagtcctgcagcatatccaacatcgaaaccgtgatcgagttccaacagaaaaacaacagactcctcgaaatcactcgagagttctccgtaaacgccggcgtcacaaccccagtctcaacatacatgctcaccaacagcgaactcctatcactaatcaacgacatgcctatcacaaatgatcagaagaaactaatgagcaacaacgtccaaatcgtccgccaacaatcatactccatcatgtgcatcataaaagaagaagtcctagcctacgtggtccagctacccctctacggcgtaattgacaccccttgctggaaactacacacttcacccctctgcacaaccaacaccaaagaaggttcaaacatctgcctcacacgaacagaccgcggctggtactgcgacaacgccggatccgtatccttcttcccccaagcagaaacctgcaaagttcaatccaaccgggtattctgcgacaccatgaactcaagaacccttccctccgaagtaaatctatgcaacgtcgacatattcaacccaaaatacgactgcaaaatcatgacctccaaaaccgatgtctccagcagcgtcatcaccagcctcggcgccatcgtctcctgctacggcaaaacaaaatgtacagcatccaacaaaaaccgaggcataatcaaaaccttctccaacgggtgcgattacgtcagcaacaaaggcgtcgacaccgtctccgtgggcaacaccctatactacgtcaacaaacaagaaggcaaatcactgtacgtaaagggcgaacccatcatcaacttctatgaccctctggtgttcccatccgatgaatttgacgcatccatatctcaggtcaacgaaaagatcaaccaatccctcgccttcatacgcaaatccgacgaactcctacacaacgtcaacgctggtaaaagcaccaccaacatcatgatcaccacaatcatcatcgtcataatcgttatcctactctcccttatagcagtcggactcctcctctactgcaaagcccgctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4588 - protein, 535 aa, synthetic construct
  REGION 1..535: note = derived and/or modified protein sequence (artificial) from HRSV(A2)__F_DSCav1_mut4
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATGSGSAICSGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYCVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 4589 - RNA, 1608 nt, synthetic construct
  misc_feature 1..1608: note = derived and/or modified CDS sequence (opt1) from HRSV(A2)__F_DSCav1_mut4
  source 1..1608: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactga

SEQ ID NO: 4590 - RNA, 1608 nt, synthetic construct
  misc_feature 1..1608: note = derived and/or modified CDS sequence (opt1) from HRSV(A2)__F_DSCav1_mut4
  source 1..1608: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactga

SEQ ID NO: 4591 - RNA, 1608 nt, synthetic construct
  misc_feature 1..1608: note = derived and/or modified CDS sequence (opt2) from HRSV(A2)__F_DSCav1_mut4
  source 1..1608: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactga

SEQ ID NO: 4592 - RNA, 1608 nt, synthetic construct
  misc_feature 1..1608: note = derived and/or modified CDS sequence (opt3) from HRSV(A2)__F_DSCav1_mut4
  source 1..1608: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactga

SEQ ID NO: 4593 - RNA, 1608 nt, synthetic construct
  misc_feature 1..1608: note = derived and/or modified CDS sequence (opt4) from HRSV(A2)__F_DSCav1_mut4
  source 1..1608: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactga

SEQ ID NO: 4594 - RNA, 1608 nt, synthetic construct
  misc_feature 1..1608: note = derived and/or modified CDS sequence (opt5) from HRSV(A2)__F_DSCav1_mut4
  source 1..1608: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactga

SEQ ID NO: 4595 - RNA, 1608 nt, synthetic construct
  misc_feature 1..1608: note = derived and/or modified CDS sequence (opt6) from HRSV(A2)__F_DSCav1_mut4
  source 1..1608: mol_type = other RNA
atggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaa

SEQ ID NO: 4596 - RNA, 1608 nt, synthetic construct
  misc_feature 1..1608: note = derived and/or modified CDS sequence (opt11) from HRSV(A2)__F_DSCav1_mut4
  source 1..1608: mol_type = other RNA
atggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaa

SEQ ID NO: 4597 - RNA, 1884 nt, synthetic construct
  misc_feature 1..1884: note = mRNA product Design a-1 comprising derived and/or modified sequence from HRSV(A2)__F_DSCav1_mut4 (opt1)
  source 1..1884: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4598 - RNA, 1884 nt, synthetic construct
  misc_feature 1..1884: note = mRNA product Design a-1 comprising derived and/or modified sequence from HRSV(A2)__F_DSCav1_mut4 (opt1)
  source 1..1884: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4599 - RNA, 1884 nt, synthetic construct
  misc_feature 1..1884: note = mRNA product Design a-1 comprising derived and/or modified sequence from HRSV(A2)__F_DSCav1_mut4 (opt2)
  source 1..1884: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4600 - RNA, 1884 nt, synthetic construct
  misc_feature 1..1884: note = mRNA product Design a-1 comprising derived and/or modified sequence from HRSV(A2)__F_DSCav1_mut4 (opt3)
  source 1..1884: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4601 - RNA, 1884 nt, synthetic construct
  misc_feature 1..1884: note = mRNA product Design a-1 comprising derived and/or modified sequence from HRSV(A2)__F_DSCav1_mut4 (opt4)
  source 1..1884: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4602 - RNA, 1884 nt, synthetic construct
  misc_feature 1..1884: note = mRNA product Design a-1 comprising derived and/or modified sequence from HRSV(A2)__F_DSCav1_mut4 (opt5)
  source 1..1884: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4603 - RNA, 1884 nt, synthetic construct
  misc_feature 1..1884: note = mRNA product Design a-1 comprising derived and/or modified sequence from HRSV(A2)__F_DSCav1_mut4 (opt6)
  source 1..1884: mol_type = other RNA
gggagagtcccgcagtcggcgtccagcggctctgcttgttcgtgtgtgtgtcgttgcaggccttattcaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4604 - RNA, 1884 nt, synthetic construct
  misc_feature 1..1884: note = mRNA product Design a-1 comprising derived and/or modified sequence from HRSV(A2)__F_DSCav1_mut4 (opt11)
  source 1..1884: mol_type = other RNA
gggagagtcccgcagtcggcgtccagcggctctgcttgttcgtgtgtgtgtcgttgcaggccttattcaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4605 - RNA, 1903 nt, synthetic construct
  misc_feature 1..1903: note = mRNA product Design a-2 comprising derived and/or modified sequence from HRSV(A2)__F_DSCav1_mut4 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4606 - RNA, 1903 nt, synthetic construct
  misc_feature 1..1903: note = mRNA product Design a-2 comprising derived and/or modified sequence from HRSV(A2)__F_DSCav1_mut4 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4607 - RNA, 1903 nt, synthetic construct
  misc_feature 1..1903: note = mRNA product Design a-2 comprising derived and/or modified sequence from HRSV(A2)__F_DSCav1_mut4 (opt2)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4608 - RNA, 1903 nt, synthetic construct
  misc_feature 1..1903: note = mRNA product Design a-2 comprising derived and/or modified sequence from HRSV(A2)__F_DSCav1_mut4 (opt3)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4609 - RNA, 1903 nt, synthetic construct
  misc_feature 1..1903: note = mRNA product Design a-2 comprising derived and/or modified sequence from HRSV(A2)__F_DSCav1_mut4 (opt4)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4610 - RNA, 1903 nt, synthetic construct
  misc_feature 1..1903: note = mRNA product Design a-2 comprising derived and/or modified sequence from HRSV(A2)__F_DSCav1_mut4 (opt5)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4611 - RNA, 1903 nt, synthetic construct
  misc_feature 1..1903: note = mRNA product Design a-2 comprising derived and/or modified sequence from HRSV(A2)__F_DSCav1_mut4 (opt6)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4612 - RNA, 1903 nt, synthetic construct
  misc_feature 1..1903: note = mRNA product Design a-2 comprising derived and/or modified sequence from HRSV(A2)__F_DSCav1_mut4 (opt11)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4613 - RNA, 1981 nt, synthetic construct
  misc_feature 1..1981: note = mRNA product Design a-3 comprising derived and/or modified sequence from HRSV(A2)__F_DSCav1_mut4 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4614 - RNA, 1981 nt, synthetic construct
  misc_feature 1..1981: note = mRNA product Design a-3 comprising derived and/or modified sequence from HRSV(A2)__F_DSCav1_mut4 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4615 - RNA, 1981 nt, synthetic construct
  misc_feature 1..1981: note = mRNA product Design a-3 comprising derived and/or modified sequence from HRSV(A2)__F_DSCav1_mut4 (opt2)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4616 - RNA, 1981 nt, synthetic construct
  misc_feature 1..1981: note = mRNA product Design a-3 comprising derived and/or modified sequence from HRSV(A2)__F_DSCav1_mut4 (opt3)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4617 - RNA, 1981 nt, synthetic construct
  misc_feature 1..1981: note = mRNA product Design a-3 comprising derived and/or modified sequence from HRSV(A2)__F_DSCav1_mut4 (opt4)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4618 - RNA, 1981 nt, synthetic construct
  misc_feature 1..1981: note = mRNA product Design a-3 comprising derived and/or modified sequence from HRSV(A2)__F_DSCav1_mut4 (opt5)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4619 - RNA, 1981 nt, synthetic construct
  misc_feature 1..1981: note = mRNA product Design a-3 comprising derived and/or modified sequence from HRSV(A2)__F_DSCav1_mut4 (opt6)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4620 - RNA, 1981 nt, synthetic construct
  misc_feature 1..1981: note = mRNA product Design a-3 comprising derived and/or modified sequence from HRSV(A2)__F_DSCav1_mut4 (opt11)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4621 - RNA, 1930 nt, synthetic construct
  misc_feature 1..1930: note = mRNA product Design a-4 comprising derived and/or modified sequence from HRSV(A2)__F_DSCav1_mut4 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4622 - RNA, 1930 nt, synthetic construct
  misc_feature 1..1930: note = mRNA product Design a-4 comprising derived and/or modified sequence from HRSV(A2)__F_DSCav1_mut4 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4623 - RNA, 1930 nt, synthetic construct
  misc_feature 1..1930: note = mRNA product Design a-4 comprising derived and/or modified sequence from HRSV(A2)__F_DSCav1_mut4 (opt2)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4624 - RNA, 1930 nt, synthetic construct
  misc_feature 1..1930: note = mRNA product Design a-4 comprising derived and/or modified sequence from HRSV(A2)__F_DSCav1_mut4 (opt3)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4625 - RNA, 1930 nt, synthetic construct
  misc_feature 1..1930: note = mRNA product Design a-4 comprising derived and/or modified sequence from HRSV(A2)__F_DSCav1_mut4 (opt4)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4626 - RNA, 1930 nt, synthetic construct
  misc_feature 1..1930: note = mRNA product Design a-4 comprising derived and/or modified sequence from HRSV(A2)__F_DSCav1_mut4 (opt5)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4627 - RNA, 1930 nt, synthetic construct
  misc_feature 1..1930: note = mRNA product Design a-4 comprising derived and/or modified sequence from HRSV(A2)__F_DSCav1_mut4 (opt6)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4628 - RNA, 1930 nt, synthetic construct
  misc_feature 1..1930: note = mRNA product Design a-4 comprising derived and/or modified sequence from HRSV(A2)__F_DSCav1_mut4 (opt11)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4629 - RNA, 1876 nt, synthetic construct
  misc_feature 1..1876: note = mRNA product Design a-5 comprising derived and/or modified sequence from HRSV(A2)__F_DSCav1_mut4 (opt1)
  source 1..1876: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4630 - RNA, 1876 nt, synthetic construct
  misc_feature 1..1876: note = mRNA product Design a-5 comprising derived and/or modified sequence from HRSV(A2)__F_DSCav1_mut4 (opt1)
  source 1..1876: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4631 - RNA, 1876 nt, synthetic construct
  misc_feature 1..1876: note = mRNA product Design a-5 comprising derived and/or modified sequence from HRSV(A2)__F_DSCav1_mut4 (opt2)
  source 1..1876: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4632 - RNA, 1876 nt, synthetic construct
  misc_feature 1..1876: note = mRNA product Design a-5 comprising derived and/or modified sequence from HRSV(A2)__F_DSCav1_mut4 (opt3)
  source 1..1876: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4633 - RNA, 1876 nt, synthetic construct
  misc_feature 1..1876: note = mRNA product Design a-5 comprising derived and/or modified sequence from HRSV(A2)__F_DSCav1_mut4 (opt4)
  source 1..1876: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4634 - RNA, 1876 nt, synthetic construct
  misc_feature 1..1876: note = mRNA product Design a-5 comprising derived and/or modified sequence from HRSV(A2)__F_DSCav1_mut4 (opt5)
  source 1..1876: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4635 - RNA, 1876 nt, synthetic construct
  misc_feature 1..1876: note = mRNA product Design a-5 comprising derived and/or modified sequence from HRSV(A2)__F_DSCav1_mut4 (opt6)
  source 1..1876: mol_type = other RNA
gggagactttcccattctgtagcagaatttggtgttgcctgtggtcttggtcccgcggagaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4636 - RNA, 1876 nt, synthetic construct
  misc_feature 1..1876: note = mRNA product Design a-5 comprising derived and/or modified sequence from HRSV(A2)__F_DSCav1_mut4 (opt11)
  source 1..1876: mol_type = other RNA
gggagactttcccattctgtagcagaatttggtgttgcctgtggtcttggtcccgcggagaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4637 - RNA, 2057 nt, synthetic construct
  misc_feature 1..2057: note = mRNA product Design b-1 comprising derived and/or modified sequence from HRSV(A2)__F_DSCav1_mut4 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4638 - RNA, 2057 nt, synthetic construct
  misc_feature 1..2057: note = mRNA product Design b-1 comprising derived and/or modified sequence from HRSV(A2)__F_DSCav1_mut4 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4639 - RNA, 2057 nt, synthetic construct
  misc_feature 1..2057: note = mRNA product Design b-1 comprising derived and/or modified sequence from HRSV(A2)__F_DSCav1_mut4 (opt2)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4640 - RNA, 2057 nt, synthetic construct
  misc_feature 1..2057: note = mRNA product Design b-1 comprising derived and/or modified sequence from HRSV(A2)__F_DSCav1_mut4 (opt3)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4641 - RNA, 2057 nt, synthetic construct
  misc_feature 1..2057: note = mRNA product Design b-1 comprising derived and/or modified sequence from HRSV(A2)__F_DSCav1_mut4 (opt4)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4642 - RNA, 2057 nt, synthetic construct
  misc_feature 1..2057: note = mRNA product Design b-1 comprising derived and/or modified sequence from HRSV(A2)__F_DSCav1_mut4 (opt5)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4643 - RNA, 2057 nt, synthetic construct
  misc_feature 1..2057: note = mRNA product Design b-1 comprising derived and/or modified sequence from HRSV(A2)__F_DSCav1_mut4 (opt6)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4644 - RNA, 2057 nt, synthetic construct
  misc_feature 1..2057: note = mRNA product Design b-1 comprising derived and/or modified sequence from HRSV(A2)__F_DSCav1_mut4 (opt11)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4645 - RNA, 1877 nt, synthetic construct
  misc_feature 1..1877: note = mRNA product Design b-2 comprising derived and/or modified sequence from HRSV(A2)__F_DSCav1_mut4 (opt1)
  source 1..1877: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4646 - RNA, 1877 nt, synthetic construct
  misc_feature 1..1877: note = mRNA product Design b-2 comprising derived and/or modified sequence from HRSV(A2)__F_DSCav1_mut4 (opt1)
  source 1..1877: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4647 - RNA, 1877 nt, synthetic construct
  misc_feature 1..1877: note = mRNA product Design b-2 comprising derived and/or modified sequence from HRSV(A2)__F_DSCav1_mut4 (opt2)
  source 1..1877: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4648 - RNA, 1877 nt, synthetic construct
  misc_feature 1..1877: note = mRNA product Design b-2 comprising derived and/or modified sequence from HRSV(A2)__F_DSCav1_mut4 (opt3)
  source 1..1877: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4649 - RNA, 1877 nt, synthetic construct
  misc_feature 1..1877: note = mRNA product Design b-2 comprising derived and/or modified sequence from HRSV(A2)__F_DSCav1_mut4 (opt4)
  source 1..1877: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4650 - RNA, 1877 nt, synthetic construct
  misc_feature 1..1877: note = mRNA product Design b-2 comprising derived and/or modified sequence from HRSV(A2)__F_DSCav1_mut4 (opt5)
  source 1..1877: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4651 - RNA, 1877 nt, synthetic construct
  misc_feature 1..1877: note = mRNA product Design b-2 comprising derived and/or modified sequence from HRSV(A2)__F_DSCav1_mut4 (opt6)
  source 1..1877: mol_type = other RNA
gggagagcctctgctggagtccggggagtggcgttggctgctagagcgaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4652 - RNA, 1877 nt, synthetic construct
  misc_feature 1..1877: note = mRNA product Design b-2 comprising derived and/or modified sequence from HRSV(A2)__F_DSCav1_mut4 (opt11)
  source 1..1877: mol_type = other RNA
gggagagcctctgctggagtccggggagtggcgttggctgctagagcgaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4653 - RNA, 1897 nt, synthetic construct
  misc_feature 1..1897: note = mRNA product Design b-3 comprising derived and/or modified sequence from HRSV(A2)__F_DSCav1_mut4 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4654 - RNA, 1897 nt, synthetic construct
  misc_feature 1..1897: note = mRNA product Design b-3 comprising derived and/or modified sequence from HRSV(A2)__F_DSCav1_mut4 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4655 - RNA, 1897 nt, synthetic construct
  misc_feature 1..1897: note = mRNA product Design b-3 comprising derived and/or modified sequence from HRSV(A2)__F_DSCav1_mut4 (opt2)
  source 1..1897: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4656 - RNA, 1897 nt, synthetic construct
  misc_feature 1..1897: note = mRNA product Design b-3 comprising derived and/or modified sequence from HRSV(A2)__F_DSCav1_mut4 (opt3)
  source 1..1897: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4657 - RNA, 1897 nt, synthetic construct
  misc_feature 1..1897: note = mRNA product Design b-3 comprising derived and/or modified sequence from HRSV(A2)__F_DSCav1_mut4 (opt4)
  source 1..1897: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4658 - RNA, 1897 nt, synthetic construct
  misc_feature 1..1897: note = mRNA product Design b-3 comprising derived and/or modified sequence from HRSV(A2)__F_DSCav1_mut4 (opt5)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4659 - RNA, 1897 nt, synthetic construct
  misc_feature 1..1897: note = mRNA product Design b-3 comprising derived and/or modified sequence from HRSV(A2)__F_DSCav1_mut4 (opt6)
  source 1..1897: mol_type = other RNA
gggagagtcccgcagtcggcgtccagcggctctgcttgttcgtgtgtgtgtcgttgcaggccttattcaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4660 - RNA, 1897 nt, synthetic construct
  misc_feature 1..1897: note = mRNA product Design b-3 comprising derived and/or modified sequence from HRSV(A2)__F_DSCav1_mut4 (opt11)
  source 1..1897: mol_type = other RNA
gggagagtcccgcagtcggcgtccagcggctctgcttgttcgtgtgtgtgtcgttgcaggccttattcaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4661 - RNA, 1948 nt, synthetic construct
  misc_feature 1..1948: note = mRNA product Design b-4 comprising derived and/or modified sequence from HRSV(A2)__F_DSCav1_mut4 (opt1)
  source 1..1948: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4662 - RNA, 1948 nt, synthetic construct
  misc_feature 1..1948: note = mRNA product Design b-4 comprising derived and/or modified sequence from HRSV(A2)__F_DSCav1_mut4 (opt1)
  source 1..1948: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4663 - RNA, 1948 nt, synthetic construct
  misc_feature 1..1948: note = mRNA product Design b-4 comprising derived and/or modified sequence from HRSV(A2)__F_DSCav1_mut4 (opt2)
  source 1..1948: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4664 - RNA, 1948 nt, synthetic construct
  misc_feature 1..1948: note = mRNA product Design b-4 comprising derived and/or modified sequence from HRSV(A2)__F_DSCav1_mut4 (opt3)
  source 1..1948: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4665 - RNA, 1948 nt, synthetic construct
  misc_feature 1..1948: note = mRNA product Design b-4 comprising derived and/or modified sequence from HRSV(A2)__F_DSCav1_mut4 (opt4)
  source 1..1948: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4666 - RNA, 1948 nt, synthetic construct
  misc_feature 1..1948: note = mRNA product Design b-4 comprising derived and/or modified sequence from HRSV(A2)__F_DSCav1_mut4 (opt5)
  source 1..1948: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4667 - RNA, 1948 nt, synthetic construct
  misc_feature 1..1948: note = mRNA product Design b-4 comprising derived and/or modified sequence from HRSV(A2)__F_DSCav1_mut4 (opt6)
  source 1..1948: mol_type = other RNA
gggagagtcccgcagtcggcgtccagcggctctgcttgttcgtgtgtgtgtcgttgcaggccttattcaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4668 - RNA, 1948 nt, synthetic construct
  misc_feature 1..1948: note = mRNA product Design b-4 comprising derived and/or modified sequence from HRSV(A2)__F_DSCav1_mut4 (opt11)
  source 1..1948: mol_type = other RNA
gggagagtcccgcagtcggcgtccagcggctctgcttgttcgtgtgtgtgtcgttgcaggccttattcaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4669 - RNA, 2010 nt, synthetic construct
  misc_feature 1..2010: note = mRNA product Design b-5 comprising derived and/or modified sequence from HRSV(A2)__F_DSCav1_mut4 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4670 - RNA, 2010 nt, synthetic construct
  misc_feature 1..2010: note = mRNA product Design b-5 comprising derived and/or modified sequence from HRSV(A2)__F_DSCav1_mut4 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4671 - RNA, 2010 nt, synthetic construct
  misc_feature 1..2010: note = mRNA product Design b-5 comprising derived and/or modified sequence from HRSV(A2)__F_DSCav1_mut4 (opt2)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4672 - RNA, 2010 nt, synthetic construct
  misc_feature 1..2010: note = mRNA product Design b-5 comprising derived and/or modified sequence from HRSV(A2)__F_DSCav1_mut4 (opt3)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4673 - RNA, 2010 nt, synthetic construct
  misc_feature 1..2010: note = mRNA product Design b-5 comprising derived and/or modified sequence from HRSV(A2)__F_DSCav1_mut4 (opt4)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4674 - RNA, 2010 nt, synthetic construct
  misc_feature 1..2010: note = mRNA product Design b-5 comprising derived and/or modified sequence from HRSV(A2)__F_DSCav1_mut4 (opt5)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4675 - RNA, 2010 nt, synthetic construct
  misc_feature 1..2010: note = mRNA product Design b-5 comprising derived and/or modified sequence from HRSV(A2)__F_DSCav1_mut4 (opt6)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4676 - RNA, 2010 nt, synthetic construct
  misc_feature 1..2010: note = mRNA product Design b-5 comprising derived and/or modified sequence from HRSV(A2)__F_DSCav1_mut4 (opt11)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4677 - RNA, 1916 nt, synthetic construct
  misc_feature 1..1916: note = mRNA product Design c-1 comprising derived and/or modified sequence from HRSV(A2)__F_DSCav1_mut4 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4678 - RNA, 1916 nt, synthetic construct
  misc_feature 1..1916: note = mRNA product Design c-1 comprising derived and/or modified sequence from HRSV(A2)__F_DSCav1_mut4 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4679 - RNA, 1916 nt, synthetic construct
  misc_feature 1..1916: note = mRNA product Design c-1 comprising derived and/or modified sequence from HRSV(A2)__F_DSCav1_mut4 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4680 - RNA, 1916 nt, synthetic construct
  misc_feature 1..1916: note = mRNA product Design c-1 comprising derived and/or modified sequence from HRSV(A2)__F_DSCav1_mut4 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4681 - RNA, 1916 nt, synthetic construct
  misc_feature 1..1916: note = mRNA product Design c-1 comprising derived and/or modified sequence from HRSV(A2)__F_DSCav1_mut4 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4682 - RNA, 1916 nt, synthetic construct
  misc_feature 1..1916: note = mRNA product Design c-1 comprising derived and/or modified sequence from HRSV(A2)__F_DSCav1_mut4 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4683 - RNA, 1916 nt, synthetic construct
  misc_feature 1..1916: note = mRNA product Design c-1 comprising derived and/or modified sequence from HRSV(A2)__F_DSCav1_mut4 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4684 - RNA, 1916 nt, synthetic construct
  misc_feature 1..1916: note = mRNA product Design c-1 comprising derived and/or modified sequence from HRSV(A2)__F_DSCav1_mut4 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4685 - RNA, 2006 nt, synthetic construct
  misc_feature 1..2006: note = mRNA product Design c-2 comprising derived and/or modified sequence from HRSV(A2)__F_DSCav1_mut4 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4686 - RNA, 2006 nt, synthetic construct
  misc_feature 1..2006: note = mRNA product Design c-2 comprising derived and/or modified sequence from HRSV(A2)__F_DSCav1_mut4 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4687 - RNA, 2006 nt, synthetic construct
  misc_feature 1..2006: note = mRNA product Design c-2 comprising derived and/or modified sequence from HRSV(A2)__F_DSCav1_mut4 (opt2)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4688 - RNA, 2006 nt, synthetic construct
  misc_feature 1..2006: note = mRNA product Design c-2 comprising derived and/or modified sequence from HRSV(A2)__F_DSCav1_mut4 (opt3)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4689 - RNA, 2006 nt, synthetic construct
  misc_feature 1..2006: note = mRNA product Design c-2 comprising derived and/or modified sequence from HRSV(A2)__F_DSCav1_mut4 (opt4)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4690 - RNA, 2006 nt, synthetic construct
  misc_feature 1..2006: note = mRNA product Design c-2 comprising derived and/or modified sequence from HRSV(A2)__F_DSCav1_mut4 (opt5)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4691 - RNA, 2006 nt, synthetic construct
  misc_feature 1..2006: note = mRNA product Design c-2 comprising derived and/or modified sequence from HRSV(A2)__F_DSCav1_mut4 (opt6)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4692 - RNA, 2006 nt, synthetic construct
  misc_feature 1..2006: note = mRNA product Design c-2 comprising derived and/or modified sequence from HRSV(A2)__F_DSCav1_mut4 (opt11)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4693 - RNA, 1983 nt, synthetic construct
  misc_feature 1..1983: note = mRNA product Design c-3 comprising derived and/or modified sequence from HRSV(A2)__F_DSCav1_mut4 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4694 - RNA, 1983 nt, synthetic construct
  misc_feature 1..1983: note = mRNA product Design c-3 comprising derived and/or modified sequence from HRSV(A2)__F_DSCav1_mut4 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4695 - RNA, 1983 nt, synthetic construct
  misc_feature 1..1983: note = mRNA product Design c-3 comprising derived and/or modified sequence from HRSV(A2)__F_DSCav1_mut4 (opt2)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4696 - RNA, 1983 nt, synthetic construct
  misc_feature 1..1983: note = mRNA product Design c-3 comprising derived and/or modified sequence from HRSV(A2)__F_DSCav1_mut4 (opt3)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4697 - RNA, 1983 nt, synthetic construct
  misc_feature 1..1983: note = mRNA product Design c-3 comprising derived and/or modified sequence from HRSV(A2)__F_DSCav1_mut4 (opt4)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4698 - RNA, 1983 nt, synthetic construct
  misc_feature 1..1983: note = mRNA product Design c-3 comprising derived and/or modified sequence from HRSV(A2)__F_DSCav1_mut4 (opt5)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4699 - RNA, 1983 nt, synthetic construct
  misc_feature 1..1983: note = mRNA product Design c-3 comprising derived and/or modified sequence from HRSV(A2)__F_DSCav1_mut4 (opt6)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4700 - RNA, 1983 nt, synthetic construct
  misc_feature 1..1983: note = mRNA product Design c-3 comprising derived and/or modified sequence from HRSV(A2)__F_DSCav1_mut4 (opt11)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4701 - RNA, 1979 nt, synthetic construct
  misc_feature 1..1979: note = mRNA product Design c-4 comprising derived and/or modified sequence from HRSV(A2)__F_DSCav1_mut4 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4702 - RNA, 1979 nt, synthetic construct
  misc_feature 1..1979: note = mRNA product Design c-4 comprising derived and/or modified sequence from HRSV(A2)__F_DSCav1_mut4 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4703 - RNA, 1979 nt, synthetic construct
  misc_feature 1..1979: note = mRNA product Design c-4 comprising derived and/or modified sequence from HRSV(A2)__F_DSCav1_mut4 (opt2)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4704 - RNA, 1979 nt, synthetic construct
  misc_feature 1..1979: note = mRNA product Design c-4 comprising derived and/or modified sequence from HRSV(A2)__F_DSCav1_mut4 (opt3)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4705 - RNA, 1979 nt, synthetic construct
  misc_feature 1..1979: note = mRNA product Design c-4 comprising derived and/or modified sequence from HRSV(A2)__F_DSCav1_mut4 (opt4)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4706 - RNA, 1979 nt, synthetic construct
  misc_feature 1..1979: note = mRNA product Design c-4 comprising derived and/or modified sequence from HRSV(A2)__F_DSCav1_mut4 (opt5)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4707 - RNA, 1979 nt, synthetic construct
  misc_feature 1..1979: note = mRNA product Design c-4 comprising derived and/or modified sequence from HRSV(A2)__F_DSCav1_mut4 (opt6)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4708 - RNA, 1979 nt, synthetic construct
  misc_feature 1..1979: note = mRNA product Design c-4 comprising derived and/or modified sequence from HRSV(A2)__F_DSCav1_mut4 (opt11)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4709 - RNA, 1897 nt, synthetic construct
  misc_feature 1..1897: note = mRNA product Design c-5 comprising derived and/or modified sequence from HRSV(A2)__F_DSCav1_mut4 (opt1)
  source 1..1897: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4710 - RNA, 1897 nt, synthetic construct
  misc_feature 1..1897: note = mRNA product Design c-5 comprising derived and/or modified sequence from HRSV(A2)__F_DSCav1_mut4 (opt1)
  source 1..1897: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4711 - RNA, 1897 nt, synthetic construct
  misc_feature 1..1897: note = mRNA product Design c-5 comprising derived and/or modified sequence from HRSV(A2)__F_DSCav1_mut4 (opt2)
  source 1..1897: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4712 - RNA, 1897 nt, synthetic construct
  misc_feature 1..1897: note = mRNA product Design c-5 comprising derived and/or modified sequence from HRSV(A2)__F_DSCav1_mut4 (opt3)
  source 1..1897: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4713 - RNA, 1897 nt, synthetic construct
  misc_feature 1..1897: note = mRNA product Design c-5 comprising derived and/or modified sequence from HRSV(A2)__F_DSCav1_mut4 (opt4)
  source 1..1897: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4714 - RNA, 1897 nt, synthetic construct
  misc_feature 1..1897: note = mRNA product Design c-5 comprising derived and/or modified sequence from HRSV(A2)__F_DSCav1_mut4 (opt5)
  source 1..1897: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4715 - RNA, 1897 nt, synthetic construct
  misc_feature 1..1897: note = mRNA product Design c-5 comprising derived and/or modified sequence from HRSV(A2)__F_DSCav1_mut4 (opt6)
  source 1..1897: mol_type = other RNA
gggagagcggctcggccattttgtcccagtcagtccggaggctgcggctgcagaagtaccgcctgcggagtaactgcaaagaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4716 - RNA, 1897 nt, synthetic construct
  misc_feature 1..1897: note = mRNA product Design c-5 comprising derived and/or modified sequence from HRSV(A2)__F_DSCav1_mut4 (opt11)
  source 1..1897: mol_type = other RNA
gggagagcggctcggccattttgtcccagtcagtccggaggctgcggctgcagaagtaccgcctgcggagtaactgcaaagaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4717 - RNA, 1906 nt, synthetic construct
  misc_feature 1..1906: note = mRNA product Design d-1 comprising derived and/or modified sequence from HRSV(A2)__F_DSCav1_mut4 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4718 - RNA, 1906 nt, synthetic construct
  misc_feature 1..1906: note = mRNA product Design d-1 comprising derived and/or modified sequence from HRSV(A2)__F_DSCav1_mut4 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4719 - RNA, 1906 nt, synthetic construct
  misc_feature 1..1906: note = mRNA product Design d-1 comprising derived and/or modified sequence from HRSV(A2)__F_DSCav1_mut4 (opt2)
  source 1..1906: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4720 - RNA, 1906 nt, synthetic construct
  misc_feature 1..1906: note = mRNA product Design d-1 comprising derived and/or modified sequence from HRSV(A2)__F_DSCav1_mut4 (opt3)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4721 - RNA, 1906 nt, synthetic construct
  misc_feature 1..1906: note = mRNA product Design d-1 comprising derived and/or modified sequence from HRSV(A2)__F_DSCav1_mut4 (opt4)
  source 1..1906: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4722 - RNA, 1906 nt, synthetic construct
  misc_feature 1..1906: note = mRNA product Design d-1 comprising derived and/or modified sequence from HRSV(A2)__F_DSCav1_mut4 (opt5)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4723 - RNA, 1906 nt, synthetic construct
  misc_feature 1..1906: note = mRNA product Design d-1 comprising derived and/or modified sequence from HRSV(A2)__F_DSCav1_mut4 (opt6)
  source 1..1906: mol_type = other RNA
gggagacccgtgacccggaagttgtacggctacgcgactttccctcccacaaaccctcgcgcccttcctttcctacttgggcccggcagaaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4724 - RNA, 1906 nt, synthetic construct
  misc_feature 1..1906: note = mRNA product Design d-1 comprising derived and/or modified sequence from HRSV(A2)__F_DSCav1_mut4 (opt11)
  source 1..1906: mol_type = other RNA
gggagacccgtgacccggaagttgtacggctacgcgactttccctcccacaaaccctcgcgcccttcctttcctacttgggcccggcagaaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4725 - RNA, 1961 nt, synthetic construct
  misc_feature 1..1961: note = mRNA product Design d-2 comprising derived and/or modified sequence from HRSV(A2)__F_DSCav1_mut4 (opt1)
  source 1..1961: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4726 - RNA, 1961 nt, synthetic construct
  misc_feature 1..1961: note = mRNA product Design d-2 comprising derived and/or modified sequence from HRSV(A2)__F_DSCav1_mut4 (opt1)
  source 1..1961: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4727 - RNA, 1961 nt, synthetic construct
  misc_feature 1..1961: note = mRNA product Design d-2 comprising derived and/or modified sequence from HRSV(A2)__F_DSCav1_mut4 (opt2)
  source 1..1961: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4728 - RNA, 1961 nt, synthetic construct
  misc_feature 1..1961: note = mRNA product Design d-2 comprising derived and/or modified sequence from HRSV(A2)__F_DSCav1_mut4 (opt3)
  source 1..1961: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4729 - RNA, 1961 nt, synthetic construct
  misc_feature 1..1961: note = mRNA product Design d-2 comprising derived and/or modified sequence from HRSV(A2)__F_DSCav1_mut4 (opt4)
  source 1..1961: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4730 - RNA, 1961 nt, synthetic construct
  misc_feature 1..1961: note = mRNA product Design d-2 comprising derived and/or modified sequence from HRSV(A2)__F_DSCav1_mut4 (opt5)
  source 1..1961: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4731 - RNA, 1961 nt, synthetic construct
  misc_feature 1..1961: note = mRNA product Design d-2 comprising derived and/or modified sequence from HRSV(A2)__F_DSCav1_mut4 (opt6)
  source 1..1961: mol_type = other RNA
gggagagcggctcggccattttgtcccagtcagtccggaggctgcggctgcagaagtaccgcctgcggagtaactgcaaagaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4732 - RNA, 1961 nt, synthetic construct
  misc_feature 1..1961: note = mRNA product Design d-2 comprising derived and/or modified sequence from HRSV(A2)__F_DSCav1_mut4 (opt11)
  source 1..1961: mol_type = other RNA
gggagagcggctcggccattttgtcccagtcagtccggaggctgcggctgcagaagtaccgcctgcggagtaactgcaaagaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4733 - RNA, 2277 nt, synthetic construct
  misc_feature 1..2277: note = mRNA product Design d-3 comprising derived and/or modified sequence from HRSV(A2)__F_DSCav1_mut4 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4734 - RNA, 2277 nt, synthetic construct
  misc_feature 1..2277: note = mRNA product Design d-3 comprising derived and/or modified sequence from HRSV(A2)__F_DSCav1_mut4 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4735 - RNA, 2277 nt, synthetic construct
  misc_feature 1..2277: note = mRNA product Design d-3 comprising derived and/or modified sequence from HRSV(A2)__F_DSCav1_mut4 (opt2)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4736 - RNA, 2277 nt, synthetic construct
  misc_feature 1..2277: note = mRNA product Design d-3 comprising derived and/or modified sequence from HRSV(A2)__F_DSCav1_mut4 (opt3)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4737 - RNA, 2277 nt, synthetic construct
  misc_feature 1..2277: note = mRNA product Design d-3 comprising derived and/or modified sequence from HRSV(A2)__F_DSCav1_mut4 (opt4)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4738 - RNA, 2277 nt, synthetic construct
  misc_feature 1..2277: note = mRNA product Design d-3 comprising derived and/or modified sequence from HRSV(A2)__F_DSCav1_mut4 (opt5)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4739 - RNA, 2277 nt, synthetic construct
  misc_feature 1..2277: note = mRNA product Design d-3 comprising derived and/or modified sequence from HRSV(A2)__F_DSCav1_mut4 (opt6)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4740 - RNA, 2277 nt, synthetic construct
  misc_feature 1..2277: note = mRNA product Design d-3 comprising derived and/or modified sequence from HRSV(A2)__F_DSCav1_mut4 (opt11)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4741 - RNA, 1960 nt, synthetic construct
  misc_feature 1..1960: note = mRNA product Design d-4 comprising derived and/or modified sequence from HRSV(A2)__F_DSCav1_mut4 (opt1)
  source 1..1960: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4742 - RNA, 1960 nt, synthetic construct
  misc_feature 1..1960: note = mRNA product Design d-4 comprising derived and/or modified sequence from HRSV(A2)__F_DSCav1_mut4 (opt1)
  source 1..1960: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4743 - RNA, 1960 nt, synthetic construct
  misc_feature 1..1960: note = mRNA product Design d-4 comprising derived and/or modified sequence from HRSV(A2)__F_DSCav1_mut4 (opt2)
  source 1..1960: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4744 - RNA, 1960 nt, synthetic construct
  misc_feature 1..1960: note = mRNA product Design d-4 comprising derived and/or modified sequence from HRSV(A2)__F_DSCav1_mut4 (opt3)
  source 1..1960: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4745 - RNA, 1960 nt, synthetic construct
  misc_feature 1..1960: note = mRNA product Design d-4 comprising derived and/or modified sequence from HRSV(A2)__F_DSCav1_mut4 (opt4)
  source 1..1960: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4746 - RNA, 1960 nt, synthetic construct
  misc_feature 1..1960: note = mRNA product Design d-4 comprising derived and/or modified sequence from HRSV(A2)__F_DSCav1_mut4 (opt5)
  source 1..1960: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4747 - RNA, 1960 nt, synthetic construct
  misc_feature 1..1960: note = mRNA product Design d-4 comprising derived and/or modified sequence from HRSV(A2)__F_DSCav1_mut4 (opt6)
  source 1..1960: mol_type = other RNA
gggagagtcccgcagtcggcgtccagcggctctgcttgttcgtgtgtgtgtcgttgcaggccttattcaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4748 - RNA, 1960 nt, synthetic construct
  misc_feature 1..1960: note = mRNA product Design d-4 comprising derived and/or modified sequence from HRSV(A2)__F_DSCav1_mut4 (opt11)
  source 1..1960: mol_type = other RNA
gggagagtcccgcagtcggcgtccagcggctctgcttgttcgtgtgtgtgtcgttgcaggccttattcaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4749 - RNA, 2057 nt, synthetic construct
  misc_feature 1..2057: note = mRNA product Design d-5 comprising derived and/or modified sequence from HRSV(A2)__F_DSCav1_mut4 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4750 - RNA, 2057 nt, synthetic construct
  misc_feature 1..2057: note = mRNA product Design d-5 comprising derived and/or modified sequence from HRSV(A2)__F_DSCav1_mut4 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4751 - RNA, 2057 nt, synthetic construct
  misc_feature 1..2057: note = mRNA product Design d-5 comprising derived and/or modified sequence from HRSV(A2)__F_DSCav1_mut4 (opt2)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4752 - RNA, 2057 nt, synthetic construct
  misc_feature 1..2057: note = mRNA product Design d-5 comprising derived and/or modified sequence from HRSV(A2)__F_DSCav1_mut4 (opt3)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4753 - RNA, 2057 nt, synthetic construct
  misc_feature 1..2057: note = mRNA product Design d-5 comprising derived and/or modified sequence from HRSV(A2)__F_DSCav1_mut4 (opt4)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4754 - RNA, 2057 nt, synthetic construct
  misc_feature 1..2057: note = mRNA product Design d-5 comprising derived and/or modified sequence from HRSV(A2)__F_DSCav1_mut4 (opt5)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4755 - RNA, 2057 nt, synthetic construct
  misc_feature 1..2057: note = mRNA product Design d-5 comprising derived and/or modified sequence from HRSV(A2)__F_DSCav1_mut4 (opt6)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4756 - RNA, 2057 nt, synthetic construct
  misc_feature 1..2057: note = mRNA product Design d-5 comprising derived and/or modified sequence from HRSV(A2)__F_DSCav1_mut4 (opt11)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4757 - RNA, 1937 nt, synthetic construct
  misc_feature 1..1937: note = mRNA product Design e-1 comprising derived and/or modified sequence from HRSV(A2)__F_DSCav1_mut4 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4758 - RNA, 1937 nt, synthetic construct
  misc_feature 1..1937: note = mRNA product Design e-1 comprising derived and/or modified sequence from HRSV(A2)__F_DSCav1_mut4 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4759 - RNA, 1937 nt, synthetic construct
  misc_feature 1..1937: note = mRNA product Design e-1 comprising derived and/or modified sequence from HRSV(A2)__F_DSCav1_mut4 (opt2)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4760 - RNA, 1937 nt, synthetic construct
  misc_feature 1..1937: note = mRNA product Design e-1 comprising derived and/or modified sequence from HRSV(A2)__F_DSCav1_mut4 (opt3)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4761 - RNA, 1937 nt, synthetic construct
  misc_feature 1..1937: note = mRNA product Design e-1 comprising derived and/or modified sequence from HRSV(A2)__F_DSCav1_mut4 (opt4)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4762 - RNA, 1937 nt, synthetic construct
  misc_feature 1..1937: note = mRNA product Design e-1 comprising derived and/or modified sequence from HRSV(A2)__F_DSCav1_mut4 (opt5)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4763 - RNA, 1937 nt, synthetic construct
  misc_feature 1..1937: note = mRNA product Design e-1 comprising derived and/or modified sequence from HRSV(A2)__F_DSCav1_mut4 (opt6)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4764 - RNA, 1937 nt, synthetic construct
  misc_feature 1..1937: note = mRNA product Design e-1 comprising derived and/or modified sequence from HRSV(A2)__F_DSCav1_mut4 (opt11)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4765 - RNA, 1919 nt, synthetic construct
  misc_feature 1..1919: note = mRNA product Design e-2 comprising derived and/or modified sequence from HRSV(A2)__F_DSCav1_mut4 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4766 - RNA, 1919 nt, synthetic construct
  misc_feature 1..1919: note = mRNA product Design e-2 comprising derived and/or modified sequence from HRSV(A2)__F_DSCav1_mut4 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4767 - RNA, 1919 nt, synthetic construct
  misc_feature 1..1919: note = mRNA product Design e-2 comprising derived and/or modified sequence from HRSV(A2)__F_DSCav1_mut4 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4768 - RNA, 1919 nt, synthetic construct
  misc_feature 1..1919: note = mRNA product Design e-2 comprising derived and/or modified sequence from HRSV(A2)__F_DSCav1_mut4 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4769 - RNA, 1919 nt, synthetic construct
  misc_feature 1..1919: note = mRNA product Design e-2 comprising derived and/or modified sequence from HRSV(A2)__F_DSCav1_mut4 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4770 - RNA, 1919 nt, synthetic construct
  misc_feature 1..1919: note = mRNA product Design e-2 comprising derived and/or modified sequence from HRSV(A2)__F_DSCav1_mut4 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4771 - RNA, 1919 nt, synthetic construct
  misc_feature 1..1919: note = mRNA product Design e-2 comprising derived and/or modified sequence from HRSV(A2)__F_DSCav1_mut4 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4772 - RNA, 1919 nt, synthetic construct
  misc_feature 1..1919: note = mRNA product Design e-2 comprising derived and/or modified sequence from HRSV(A2)__F_DSCav1_mut4 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4773 - RNA, 1889 nt, synthetic construct
  misc_feature 1..1889: note = mRNA product Design e-3 comprising derived and/or modified sequence from HRSV(A2)__F_DSCav1_mut4 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4774 - RNA, 1889 nt, synthetic construct
  misc_feature 1..1889: note = mRNA product Design e-3 comprising derived and/or modified sequence from HRSV(A2)__F_DSCav1_mut4 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4775 - RNA, 1889 nt, synthetic construct
  misc_feature 1..1889: note = mRNA product Design e-3 comprising derived and/or modified sequence from HRSV(A2)__F_DSCav1_mut4 (opt2)
  source 1..1889: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4776 - RNA, 1889 nt, synthetic construct
  misc_feature 1..1889: note = mRNA product Design e-3 comprising derived and/or modified sequence from HRSV(A2)__F_DSCav1_mut4 (opt3)
  source 1..1889: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4777 - RNA, 1889 nt, synthetic construct
  misc_feature 1..1889: note = mRNA product Design e-3 comprising derived and/or modified sequence from HRSV(A2)__F_DSCav1_mut4 (opt4)
  source 1..1889: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4778 - RNA, 1889 nt, synthetic construct
  misc_feature 1..1889: note = mRNA product Design e-3 comprising derived and/or modified sequence from HRSV(A2)__F_DSCav1_mut4 (opt5)
  source 1..1889: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4779 - RNA, 1889 nt, synthetic construct
  misc_feature 1..1889: note = mRNA product Design e-3 comprising derived and/or modified sequence from HRSV(A2)__F_DSCav1_mut4 (opt6)
  source 1..1889: mol_type = other RNA
gggagactttcccattctgtagcagaatttggtgttgcctgtggtcttggtcccgcggagaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4780 - RNA, 1889 nt, synthetic construct
  misc_feature 1..1889: note = mRNA product Design e-3 comprising derived and/or modified sequence from HRSV(A2)__F_DSCav1_mut4 (opt11)
  source 1..1889: mol_type = other RNA
gggagactttcccattctgtagcagaatttggtgttgcctgtggtcttggtcccgcggagaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4781 - RNA, 1943 nt, synthetic construct
  misc_feature 1..1943: note = mRNA product Design e-4 comprising derived and/or modified sequence from HRSV(A2)__F_DSCav1_mut4 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4782 - RNA, 1943 nt, synthetic construct
  misc_feature 1..1943: note = mRNA product Design e-4 comprising derived and/or modified sequence from HRSV(A2)__F_DSCav1_mut4 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4783 - RNA, 1943 nt, synthetic construct
  misc_feature 1..1943: note = mRNA product Design e-4 comprising derived and/or modified sequence from HRSV(A2)__F_DSCav1_mut4 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4784 - RNA, 1943 nt, synthetic construct
  misc_feature 1..1943: note = mRNA product Design e-4 comprising derived and/or modified sequence from HRSV(A2)__F_DSCav1_mut4 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4785 - RNA, 1943 nt, synthetic construct
  misc_feature 1..1943: note = mRNA product Design e-4 comprising derived and/or modified sequence from HRSV(A2)__F_DSCav1_mut4 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4786 - RNA, 1943 nt, synthetic construct
  misc_feature 1..1943: note = mRNA product Design e-4 comprising derived and/or modified sequence from HRSV(A2)__F_DSCav1_mut4 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4787 - RNA, 1943 nt, synthetic construct
  misc_feature 1..1943: note = mRNA product Design e-4 comprising derived and/or modified sequence from HRSV(A2)__F_DSCav1_mut4 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4788 - RNA, 1943 nt, synthetic construct
  misc_feature 1..1943: note = mRNA product Design e-4 comprising derived and/or modified sequence from HRSV(A2)__F_DSCav1_mut4 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4789 - RNA, 1910 nt, synthetic construct
  misc_feature 1..1910: note = mRNA product Design e-5 comprising derived and/or modified sequence from HRSV(A2)__F_DSCav1_mut4 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4790 - RNA, 1910 nt, synthetic construct
  misc_feature 1..1910: note = mRNA product Design e-5 comprising derived and/or modified sequence from HRSV(A2)__F_DSCav1_mut4 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4791 - RNA, 1910 nt, synthetic construct
  misc_feature 1..1910: note = mRNA product Design e-5 comprising derived and/or modified sequence from HRSV(A2)__F_DSCav1_mut4 (opt2)
  source 1..1910: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4792 - RNA, 1910 nt, synthetic construct
  misc_feature 1..1910: note = mRNA product Design e-5 comprising derived and/or modified sequence from HRSV(A2)__F_DSCav1_mut4 (opt3)
  source 1..1910: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4793 - RNA, 1910 nt, synthetic construct
  misc_feature 1..1910: note = mRNA product Design e-5 comprising derived and/or modified sequence from HRSV(A2)__F_DSCav1_mut4 (opt4)
  source 1..1910: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4794 - RNA, 1910 nt, synthetic construct
  misc_feature 1..1910: note = mRNA product Design e-5 comprising derived and/or modified sequence from HRSV(A2)__F_DSCav1_mut4 (opt5)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4795 - RNA, 1910 nt, synthetic construct
  misc_feature 1..1910: note = mRNA product Design e-5 comprising derived and/or modified sequence from HRSV(A2)__F_DSCav1_mut4 (opt6)
  source 1..1910: mol_type = other RNA
gggagagcggctcggccattttgtcccagtcagtccggaggctgcggctgcagaagtaccgcctgcggagtaactgcaaagaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4796 - RNA, 1910 nt, synthetic construct
  misc_feature 1..1910: note = mRNA product Design e-5 comprising derived and/or modified sequence from HRSV(A2)__F_DSCav1_mut4 (opt11)
  source 1..1910: mol_type = other RNA
gggagagcggctcggccattttgtcccagtcagtccggaggctgcggctgcagaagtaccgcctgcggagtaactgcaaagaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4797 - RNA, 1977 nt, synthetic construct
  misc_feature 1..1977: note = mRNA product Design e-6 comprising derived and/or modified sequence from HRSV(A2)__F_DSCav1_mut4 (opt1)
  source 1..1977: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4798 - RNA, 1977 nt, synthetic construct
  misc_feature 1..1977: note = mRNA product Design e-6 comprising derived and/or modified sequence from HRSV(A2)__F_DSCav1_mut4 (opt1)
  source 1..1977: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4799 - RNA, 1977 nt, synthetic construct
  misc_feature 1..1977: note = mRNA product Design e-6 comprising derived and/or modified sequence from HRSV(A2)__F_DSCav1_mut4 (opt2)
  source 1..1977: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4800 - RNA, 1977 nt, synthetic construct
  misc_feature 1..1977: note = mRNA product Design e-6 comprising derived and/or modified sequence from HRSV(A2)__F_DSCav1_mut4 (opt3)
  source 1..1977: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4801 - RNA, 1977 nt, synthetic construct
  misc_feature 1..1977: note = mRNA product Design e-6 comprising derived and/or modified sequence from HRSV(A2)__F_DSCav1_mut4 (opt4)
  source 1..1977: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4802 - RNA, 1977 nt, synthetic construct
  misc_feature 1..1977: note = mRNA product Design e-6 comprising derived and/or modified sequence from HRSV(A2)__F_DSCav1_mut4 (opt5)
  source 1..1977: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4803 - RNA, 1977 nt, synthetic construct
  misc_feature 1..1977: note = mRNA product Design e-6 comprising derived and/or modified sequence from HRSV(A2)__F_DSCav1_mut4 (opt6)
  source 1..1977: mol_type = other RNA
gggagagcggctcggccattttgtcccagtcagtccggaggctgcggctgcagaagtaccgcctgcggagtaactgcaaagaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4804 - RNA, 1977 nt, synthetic construct
  misc_feature 1..1977: note = mRNA product Design e-6 comprising derived and/or modified sequence from HRSV(A2)__F_DSCav1_mut4 (opt11)
  source 1..1977: mol_type = other RNA
gggagagcggctcggccattttgtcccagtcagtccggaggctgcggctgcagaagtaccgcctgcggagtaactgcaaagaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4805 - RNA, 2193 nt, synthetic construct
  misc_feature 1..2193: note = mRNA product Design f-1 comprising derived and/or modified sequence from HRSV(A2)__F_DSCav1_mut4 (opt1)
  source 1..2193: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4806 - RNA, 2193 nt, synthetic construct
  misc_feature 1..2193: note = mRNA product Design f-1 comprising derived and/or modified sequence from HRSV(A2)__F_DSCav1_mut4 (opt1)
  source 1..2193: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4807 - RNA, 2193 nt, synthetic construct
  misc_feature 1..2193: note = mRNA product Design f-1 comprising derived and/or modified sequence from HRSV(A2)__F_DSCav1_mut4 (opt2)
  source 1..2193: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4808 - RNA, 2193 nt, synthetic construct
  misc_feature 1..2193: note = mRNA product Design f-1 comprising derived and/or modified sequence from HRSV(A2)__F_DSCav1_mut4 (opt3)
  source 1..2193: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4809 - RNA, 2193 nt, synthetic construct
  misc_feature 1..2193: note = mRNA product Design f-1 comprising derived and/or modified sequence from HRSV(A2)__F_DSCav1_mut4 (opt4)
  source 1..2193: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4810 - RNA, 2193 nt, synthetic construct
  misc_feature 1..2193: note = mRNA product Design f-1 comprising derived and/or modified sequence from HRSV(A2)__F_DSCav1_mut4 (opt5)
  source 1..2193: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4811 - RNA, 2193 nt, synthetic construct
  misc_feature 1..2193: note = mRNA product Design f-1 comprising derived and/or modified sequence from HRSV(A2)__F_DSCav1_mut4 (opt6)
  source 1..2193: mol_type = other RNA
gggagagcggctcggccattttgtcccagtcagtccggaggctgcggctgcagaagtaccgcctgcggagtaactgcaaagaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4812 - RNA, 2193 nt, synthetic construct
  misc_feature 1..2193: note = mRNA product Design f-1 comprising derived and/or modified sequence from HRSV(A2)__F_DSCav1_mut4 (opt11)
  source 1..2193: mol_type = other RNA
gggagagcggctcggccattttgtcccagtcagtccggaggctgcggctgcagaagtaccgcctgcggagtaactgcaaagaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4813 - RNA, 1973 nt, synthetic construct
  misc_feature 1..1973: note = mRNA product Design f-2 comprising derived and/or modified sequence from HRSV(A2)__F_DSCav1_mut4 (opt1)
  source 1..1973: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4814 - RNA, 1973 nt, synthetic construct
  misc_feature 1..1973: note = mRNA product Design f-2 comprising derived and/or modified sequence from HRSV(A2)__F_DSCav1_mut4 (opt1)
  source 1..1973: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4815 - RNA, 1973 nt, synthetic construct
  misc_feature 1..1973: note = mRNA product Design f-2 comprising derived and/or modified sequence from HRSV(A2)__F_DSCav1_mut4 (opt2)
  source 1..1973: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4816 - RNA, 1973 nt, synthetic construct
  misc_feature 1..1973: note = mRNA product Design f-2 comprising derived and/or modified sequence from HRSV(A2)__F_DSCav1_mut4 (opt3)
  source 1..1973: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4817 - RNA, 1973 nt, synthetic construct
  misc_feature 1..1973: note = mRNA product Design f-2 comprising derived and/or modified sequence from HRSV(A2)__F_DSCav1_mut4 (opt4)
  source 1..1973: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4818 - RNA, 1973 nt, synthetic construct
  misc_feature 1..1973: note = mRNA product Design f-2 comprising derived and/or modified sequence from HRSV(A2)__F_DSCav1_mut4 (opt5)
  source 1..1973: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4819 - RNA, 1973 nt, synthetic construct
  misc_feature 1..1973: note = mRNA product Design f-2 comprising derived and/or modified sequence from HRSV(A2)__F_DSCav1_mut4 (opt6)
  source 1..1973: mol_type = other RNA
gggagagcggctcggccattttgtcccagtcagtccggaggctgcggctgcagaagtaccgcctgcggagtaactgcaaagaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4820 - RNA, 1973 nt, synthetic construct
  misc_feature 1..1973: note = mRNA product Design f-2 comprising derived and/or modified sequence from HRSV(A2)__F_DSCav1_mut4 (opt11)
  source 1..1973: mol_type = other RNA
gggagagcggctcggccattttgtcccagtcagtccggaggctgcggctgcagaagtaccgcctgcggagtaactgcaaagaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4821 - RNA, 1964 nt, synthetic construct
  misc_feature 1..1964: note = mRNA product Design f-3 comprising derived and/or modified sequence from HRSV(A2)__F_DSCav1_mut4 (opt1)
  source 1..1964: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4822 - RNA, 1964 nt, synthetic construct
  misc_feature 1..1964: note = mRNA product Design f-3 comprising derived and/or modified sequence from HRSV(A2)__F_DSCav1_mut4 (opt1)
  source 1..1964: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4823 - RNA, 1964 nt, synthetic construct
  misc_feature 1..1964: note = mRNA product Design f-3 comprising derived and/or modified sequence from HRSV(A2)__F_DSCav1_mut4 (opt2)
  source 1..1964: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4824 - RNA, 1964 nt, synthetic construct
  misc_feature 1..1964: note = mRNA product Design f-3 comprising derived and/or modified sequence from HRSV(A2)__F_DSCav1_mut4 (opt3)
  source 1..1964: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4825 - RNA, 1964 nt, synthetic construct
  misc_feature 1..1964: note = mRNA product Design f-3 comprising derived and/or modified sequence from HRSV(A2)__F_DSCav1_mut4 (opt4)
  source 1..1964: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4826 - RNA, 1964 nt, synthetic construct
  misc_feature 1..1964: note = mRNA product Design f-3 comprising derived and/or modified sequence from HRSV(A2)__F_DSCav1_mut4 (opt5)
  source 1..1964: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4827 - RNA, 1964 nt, synthetic construct
  misc_feature 1..1964: note = mRNA product Design f-3 comprising derived and/or modified sequence from HRSV(A2)__F_DSCav1_mut4 (opt6)
  source 1..1964: mol_type = other RNA
gggagagtcccgcagtcggcgtccagcggctctgcttgttcgtgtgtgtgtcgttgcaggccttattcaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4828 - RNA, 1964 nt, synthetic construct
  misc_feature 1..1964: note = mRNA product Design f-3 comprising derived and/or modified sequence from HRSV(A2)__F_DSCav1_mut4 (opt11)
  source 1..1964: mol_type = other RNA
gggagagtcccgcagtcggcgtccagcggctctgcttgttcgtgtgtgtgtcgttgcaggccttattcaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4829 - RNA, 2180 nt, synthetic construct
  misc_feature 1..2180: note = mRNA product Design f-4 comprising derived and/or modified sequence from HRSV(A2)__F_DSCav1_mut4 (opt1)
  source 1..2180: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4830 - RNA, 2180 nt, synthetic construct
  misc_feature 1..2180: note = mRNA product Design f-4 comprising derived and/or modified sequence from HRSV(A2)__F_DSCav1_mut4 (opt1)
  source 1..2180: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4831 - RNA, 2180 nt, synthetic construct
  misc_feature 1..2180: note = mRNA product Design f-4 comprising derived and/or modified sequence from HRSV(A2)__F_DSCav1_mut4 (opt2)
  source 1..2180: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4832 - RNA, 2180 nt, synthetic construct
  misc_feature 1..2180: note = mRNA product Design f-4 comprising derived and/or modified sequence from HRSV(A2)__F_DSCav1_mut4 (opt3)
  source 1..2180: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4833 - RNA, 2180 nt, synthetic construct
  misc_feature 1..2180: note = mRNA product Design f-4 comprising derived and/or modified sequence from HRSV(A2)__F_DSCav1_mut4 (opt4)
  source 1..2180: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4834 - RNA, 2180 nt, synthetic construct
  misc_feature 1..2180: note = mRNA product Design f-4 comprising derived and/or modified sequence from HRSV(A2)__F_DSCav1_mut4 (opt5)
  source 1..2180: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4835 - RNA, 2180 nt, synthetic construct
  misc_feature 1..2180: note = mRNA product Design f-4 comprising derived and/or modified sequence from HRSV(A2)__F_DSCav1_mut4 (opt6)
  source 1..2180: mol_type = other RNA
gggagagtcccgcagtcggcgtccagcggctctgcttgttcgtgtgtgtgtcgttgcaggccttattcaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4836 - RNA, 2180 nt, synthetic construct
  misc_feature 1..2180: note = mRNA product Design f-4 comprising derived and/or modified sequence from HRSV(A2)__F_DSCav1_mut4 (opt11)
  source 1..2180: mol_type = other RNA
gggagagtcccgcagtcggcgtccagcggctctgcttgttcgtgtgtgtgtcgttgcaggccttattcaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4837 - RNA, 1956 nt, synthetic construct
  misc_feature 1..1956: note = mRNA product Design f-5 comprising derived and/or modified sequence from HRSV(A2)__F_DSCav1_mut4 (opt1)
  source 1..1956: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4838 - RNA, 1956 nt, synthetic construct
  misc_feature 1..1956: note = mRNA product Design f-5 comprising derived and/or modified sequence from HRSV(A2)__F_DSCav1_mut4 (opt1)
  source 1..1956: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4839 - RNA, 1956 nt, synthetic construct
  misc_feature 1..1956: note = mRNA product Design f-5 comprising derived and/or modified sequence from HRSV(A2)__F_DSCav1_mut4 (opt2)
  source 1..1956: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4840 - RNA, 1956 nt, synthetic construct
  misc_feature 1..1956: note = mRNA product Design f-5 comprising derived and/or modified sequence from HRSV(A2)__F_DSCav1_mut4 (opt3)
  source 1..1956: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4841 - RNA, 1956 nt, synthetic construct
  misc_feature 1..1956: note = mRNA product Design f-5 comprising derived and/or modified sequence from HRSV(A2)__F_DSCav1_mut4 (opt4)
  source 1..1956: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4842 - RNA, 1956 nt, synthetic construct
  misc_feature 1..1956: note = mRNA product Design f-5 comprising derived and/or modified sequence from HRSV(A2)__F_DSCav1_mut4 (opt5)
  source 1..1956: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4843 - RNA, 1956 nt, synthetic construct
  misc_feature 1..1956: note = mRNA product Design f-5 comprising derived and/or modified sequence from HRSV(A2)__F_DSCav1_mut4 (opt6)
  source 1..1956: mol_type = other RNA
gggagactttcccattctgtagcagaatttggtgttgcctgtggtcttggtcccgcggagaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4844 - RNA, 1956 nt, synthetic construct
  misc_feature 1..1956: note = mRNA product Design f-5 comprising derived and/or modified sequence from HRSV(A2)__F_DSCav1_mut4 (opt11)
  source 1..1956: mol_type = other RNA
gggagactttcccattctgtagcagaatttggtgttgcctgtggtcttggtcccgcggagaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4845 - RNA, 1952 nt, synthetic construct
  misc_feature 1..1952: note = mRNA product Design g-1 comprising derived and/or modified sequence from HRSV(A2)__F_DSCav1_mut4 (opt1)
  source 1..1952: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4846 - RNA, 1952 nt, synthetic construct
  misc_feature 1..1952: note = mRNA product Design g-1 comprising derived and/or modified sequence from HRSV(A2)__F_DSCav1_mut4 (opt1)
  source 1..1952: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4847 - RNA, 1952 nt, synthetic construct
  misc_feature 1..1952: note = mRNA product Design g-1 comprising derived and/or modified sequence from HRSV(A2)__F_DSCav1_mut4 (opt2)
  source 1..1952: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4848 - RNA, 1952 nt, synthetic construct
  misc_feature 1..1952: note = mRNA product Design g-1 comprising derived and/or modified sequence from HRSV(A2)__F_DSCav1_mut4 (opt3)
  source 1..1952: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4849 - RNA, 1952 nt, synthetic construct
  misc_feature 1..1952: note = mRNA product Design g-1 comprising derived and/or modified sequence from HRSV(A2)__F_DSCav1_mut4 (opt4)
  source 1..1952: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4850 - RNA, 1952 nt, synthetic construct
  misc_feature 1..1952: note = mRNA product Design g-1 comprising derived and/or modified sequence from HRSV(A2)__F_DSCav1_mut4 (opt5)
  source 1..1952: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4851 - RNA, 1952 nt, synthetic construct
  misc_feature 1..1952: note = mRNA product Design g-1 comprising derived and/or modified sequence from HRSV(A2)__F_DSCav1_mut4 (opt6)
  source 1..1952: mol_type = other RNA
gggagactttcccattctgtagcagaatttggtgttgcctgtggtcttggtcccgcggagaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4852 - RNA, 1952 nt, synthetic construct
  misc_feature 1..1952: note = mRNA product Design g-1 comprising derived and/or modified sequence from HRSV(A2)__F_DSCav1_mut4 (opt11)
  source 1..1952: mol_type = other RNA
gggagactttcccattctgtagcagaatttggtgttgcctgtggtcttggtcccgcggagaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4853 - RNA, 1967 nt, synthetic construct
  misc_feature 1..1967: note = mRNA product Design g-2 comprising derived and/or modified sequence from HRSV(A2)__F_DSCav1_mut4 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4854 - RNA, 1967 nt, synthetic construct
  misc_feature 1..1967: note = mRNA product Design g-2 comprising derived and/or modified sequence from HRSV(A2)__F_DSCav1_mut4 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4855 - RNA, 1967 nt, synthetic construct
  misc_feature 1..1967: note = mRNA product Design g-2 comprising derived and/or modified sequence from HRSV(A2)__F_DSCav1_mut4 (opt2)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4856 - RNA, 1967 nt, synthetic construct
  misc_feature 1..1967: note = mRNA product Design g-2 comprising derived and/or modified sequence from HRSV(A2)__F_DSCav1_mut4 (opt3)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4857 - RNA, 1967 nt, synthetic construct
  misc_feature 1..1967: note = mRNA product Design g-2 comprising derived and/or modified sequence from HRSV(A2)__F_DSCav1_mut4 (opt4)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4858 - RNA, 1967 nt, synthetic construct
  misc_feature 1..1967: note = mRNA product Design g-2 comprising derived and/or modified sequence from HRSV(A2)__F_DSCav1_mut4 (opt5)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4859 - RNA, 1967 nt, synthetic construct
  misc_feature 1..1967: note = mRNA product Design g-2 comprising derived and/or modified sequence from HRSV(A2)__F_DSCav1_mut4 (opt6)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4860 - RNA, 1967 nt, synthetic construct
  misc_feature 1..1967: note = mRNA product Design g-2 comprising derived and/or modified sequence from HRSV(A2)__F_DSCav1_mut4 (opt11)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4861 - RNA, 2199 nt, synthetic construct
  misc_feature 1..2199: note = mRNA product Design g-3 comprising derived and/or modified sequence from HRSV(A2)__F_DSCav1_mut4 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4862 - RNA, 2199 nt, synthetic construct
  misc_feature 1..2199: note = mRNA product Design g-3 comprising derived and/or modified sequence from HRSV(A2)__F_DSCav1_mut4 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4863 - RNA, 2199 nt, synthetic construct
  misc_feature 1..2199: note = mRNA product Design g-3 comprising derived and/or modified sequence from HRSV(A2)__F_DSCav1_mut4 (opt2)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4864 - RNA, 2199 nt, synthetic construct
  misc_feature 1..2199: note = mRNA product Design g-3 comprising derived and/or modified sequence from HRSV(A2)__F_DSCav1_mut4 (opt3)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4865 - RNA, 2199 nt, synthetic construct
  misc_feature 1..2199: note = mRNA product Design g-3 comprising derived and/or modified sequence from HRSV(A2)__F_DSCav1_mut4 (opt4)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4866 - RNA, 2199 nt, synthetic construct
  misc_feature 1..2199: note = mRNA product Design g-3 comprising derived and/or modified sequence from HRSV(A2)__F_DSCav1_mut4 (opt5)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4867 - RNA, 2199 nt, synthetic construct
  misc_feature 1..2199: note = mRNA product Design g-3 comprising derived and/or modified sequence from HRSV(A2)__F_DSCav1_mut4 (opt6)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4868 - RNA, 2199 nt, synthetic construct
  misc_feature 1..2199: note = mRNA product Design g-3 comprising derived and/or modified sequence from HRSV(A2)__F_DSCav1_mut4 (opt11)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4869 - RNA, 1994 nt, synthetic construct
  misc_feature 1..1994: note = mRNA product Design g-4 comprising derived and/or modified sequence from HRSV(A2)__F_DSCav1_mut4 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4870 - RNA, 1994 nt, synthetic construct
  misc_feature 1..1994: note = mRNA product Design g-4 comprising derived and/or modified sequence from HRSV(A2)__F_DSCav1_mut4 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4871 - RNA, 1994 nt, synthetic construct
  misc_feature 1..1994: note = mRNA product Design g-4 comprising derived and/or modified sequence from HRSV(A2)__F_DSCav1_mut4 (opt2)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4872 - RNA, 1994 nt, synthetic construct
  misc_feature 1..1994: note = mRNA product Design g-4 comprising derived and/or modified sequence from HRSV(A2)__F_DSCav1_mut4 (opt3)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4873 - RNA, 1994 nt, synthetic construct
  misc_feature 1..1994: note = mRNA product Design g-4 comprising derived and/or modified sequence from HRSV(A2)__F_DSCav1_mut4 (opt4)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4874 - RNA, 1994 nt, synthetic construct
  misc_feature 1..1994: note = mRNA product Design g-4 comprising derived and/or modified sequence from HRSV(A2)__F_DSCav1_mut4 (opt5)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4875 - RNA, 1994 nt, synthetic construct
  misc_feature 1..1994: note = mRNA product Design g-4 comprising derived and/or modified sequence from HRSV(A2)__F_DSCav1_mut4 (opt6)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4876 - RNA, 1994 nt, synthetic construct
  misc_feature 1..1994: note = mRNA product Design g-4 comprising derived and/or modified sequence from HRSV(A2)__F_DSCav1_mut4 (opt11)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4877 - RNA, 1970 nt, synthetic construct
  misc_feature 1..1970: note = mRNA product Design g-5 comprising derived and/or modified sequence from HRSV(A2)__F_DSCav1_mut4 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4878 - RNA, 1970 nt, synthetic construct
  misc_feature 1..1970: note = mRNA product Design g-5 comprising derived and/or modified sequence from HRSV(A2)__F_DSCav1_mut4 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4879 - RNA, 1970 nt, synthetic construct
  misc_feature 1..1970: note = mRNA product Design g-5 comprising derived and/or modified sequence from HRSV(A2)__F_DSCav1_mut4 (opt2)
  source 1..1970: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4880 - RNA, 1970 nt, synthetic construct
  misc_feature 1..1970: note = mRNA product Design g-5 comprising derived and/or modified sequence from HRSV(A2)__F_DSCav1_mut4 (opt3)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4881 - RNA, 1970 nt, synthetic construct
  misc_feature 1..1970: note = mRNA product Design g-5 comprising derived and/or modified sequence from HRSV(A2)__F_DSCav1_mut4 (opt4)
  source 1..1970: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4882 - RNA, 1970 nt, synthetic construct
  misc_feature 1..1970: note = mRNA product Design g-5 comprising derived and/or modified sequence from HRSV(A2)__F_DSCav1_mut4 (opt5)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4883 - RNA, 1970 nt, synthetic construct
  misc_feature 1..1970: note = mRNA product Design g-5 comprising derived and/or modified sequence from HRSV(A2)__F_DSCav1_mut4 (opt6)
  source 1..1970: mol_type = other RNA
gggagacccgtgacccggaagttgtacggctacgcgactttccctcccacaaaccctcgcgcccttcctttcctacttgggcccggcagaaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4884 - RNA, 1970 nt, synthetic construct
  misc_feature 1..1970: note = mRNA product Design g-5 comprising derived and/or modified sequence from HRSV(A2)__F_DSCav1_mut4 (opt11)
  source 1..1970: mol_type = other RNA
gggagacccgtgacccggaagttgtacggctacgcgactttccctcccacaaaccctcgcgcccttcctttcctacttgggcccggcagaaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4885 - RNA, 1986 nt, synthetic construct
  misc_feature 1..1986: note = mRNA product Design h-1 comprising derived and/or modified sequence from HRSV(A2)__F_DSCav1_mut4 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4886 - RNA, 1986 nt, synthetic construct
  misc_feature 1..1986: note = mRNA product Design h-1 comprising derived and/or modified sequence from HRSV(A2)__F_DSCav1_mut4 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4887 - RNA, 1986 nt, synthetic construct
  misc_feature 1..1986: note = mRNA product Design h-1 comprising derived and/or modified sequence from HRSV(A2)__F_DSCav1_mut4 (opt2)
  source 1..1986: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4888 - RNA, 1986 nt, synthetic construct
  misc_feature 1..1986: note = mRNA product Design h-1 comprising derived and/or modified sequence from HRSV(A2)__F_DSCav1_mut4 (opt3)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4889 - RNA, 1986 nt, synthetic construct
  misc_feature 1..1986: note = mRNA product Design h-1 comprising derived and/or modified sequence from HRSV(A2)__F_DSCav1_mut4 (opt4)
  source 1..1986: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4890 - RNA, 1986 nt, synthetic construct
  misc_feature 1..1986: note = mRNA product Design h-1 comprising derived and/or modified sequence from HRSV(A2)__F_DSCav1_mut4 (opt5)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4891 - RNA, 1986 nt, synthetic construct
  misc_feature 1..1986: note = mRNA product Design h-1 comprising derived and/or modified sequence from HRSV(A2)__F_DSCav1_mut4 (opt6)
  source 1..1986: mol_type = other RNA
gggagacccgtgacccggaagttgtacggctacgcgactttccctcccacaaaccctcgcgcccttcctttcctacttgggcccggcagaaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4892 - RNA, 1986 nt, synthetic construct
  misc_feature 1..1986: note = mRNA product Design h-1 comprising derived and/or modified sequence from HRSV(A2)__F_DSCav1_mut4 (opt11)
  source 1..1986: mol_type = other RNA
gggagacccgtgacccggaagttgtacggctacgcgactttccctcccacaaaccctcgcgcccttcctttcctacttgggcccggcagaaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4893 - RNA, 2202 nt, synthetic construct
  misc_feature 1..2202: note = mRNA product Design h-2 comprising derived and/or modified sequence from HRSV(A2)__F_DSCav1_mut4 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4894 - RNA, 2202 nt, synthetic construct
  misc_feature 1..2202: note = mRNA product Design h-2 comprising derived and/or modified sequence from HRSV(A2)__F_DSCav1_mut4 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4895 - RNA, 2202 nt, synthetic construct
  misc_feature 1..2202: note = mRNA product Design h-2 comprising derived and/or modified sequence from HRSV(A2)__F_DSCav1_mut4 (opt2)
  source 1..2202: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4896 - RNA, 2202 nt, synthetic construct
  misc_feature 1..2202: note = mRNA product Design h-2 comprising derived and/or modified sequence from HRSV(A2)__F_DSCav1_mut4 (opt3)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4897 - RNA, 2202 nt, synthetic construct
  misc_feature 1..2202: note = mRNA product Design h-2 comprising derived and/or modified sequence from HRSV(A2)__F_DSCav1_mut4 (opt4)
  source 1..2202: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4898 - RNA, 2202 nt, synthetic construct
  misc_feature 1..2202: note = mRNA product Design h-2 comprising derived and/or modified sequence from HRSV(A2)__F_DSCav1_mut4 (opt5)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4899 - RNA, 2202 nt, synthetic construct
  misc_feature 1..2202: note = mRNA product Design h-2 comprising derived and/or modified sequence from HRSV(A2)__F_DSCav1_mut4 (opt6)
  source 1..2202: mol_type = other RNA
gggagacccgtgacccggaagttgtacggctacgcgactttccctcccacaaaccctcgcgcccttcctttcctacttgggcccggcagaaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4900 - RNA, 2202 nt, synthetic construct
  misc_feature 1..2202: note = mRNA product Design h-2 comprising derived and/or modified sequence from HRSV(A2)__F_DSCav1_mut4 (opt11)
  source 1..2202: mol_type = other RNA
gggagacccgtgacccggaagttgtacggctacgcgactttccctcccacaaaccctcgcgcccttcctttcctacttgggcccggcagaaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4901 - RNA, 1982 nt, synthetic construct
  misc_feature 1..1982: note = mRNA product Design h-3 comprising derived and/or modified sequence from HRSV(A2)__F_DSCav1_mut4 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4902 - RNA, 1982 nt, synthetic construct
  misc_feature 1..1982: note = mRNA product Design h-3 comprising derived and/or modified sequence from HRSV(A2)__F_DSCav1_mut4 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4903 - RNA, 1982 nt, synthetic construct
  misc_feature 1..1982: note = mRNA product Design h-3 comprising derived and/or modified sequence from HRSV(A2)__F_DSCav1_mut4 (opt2)
  source 1..1982: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4904 - RNA, 1982 nt, synthetic construct
  misc_feature 1..1982: note = mRNA product Design h-3 comprising derived and/or modified sequence from HRSV(A2)__F_DSCav1_mut4 (opt3)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4905 - RNA, 1982 nt, synthetic construct
  misc_feature 1..1982: note = mRNA product Design h-3 comprising derived and/or modified sequence from HRSV(A2)__F_DSCav1_mut4 (opt4)
  source 1..1982: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4906 - RNA, 1982 nt, synthetic construct
  misc_feature 1..1982: note = mRNA product Design h-3 comprising derived and/or modified sequence from HRSV(A2)__F_DSCav1_mut4 (opt5)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4907 - RNA, 1982 nt, synthetic construct
  misc_feature 1..1982: note = mRNA product Design h-3 comprising derived and/or modified sequence from HRSV(A2)__F_DSCav1_mut4 (opt6)
  source 1..1982: mol_type = other RNA
gggagacccgtgacccggaagttgtacggctacgcgactttccctcccacaaaccctcgcgcccttcctttcctacttgggcccggcagaaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4908 - RNA, 1982 nt, synthetic construct
  misc_feature 1..1982: note = mRNA product Design h-3 comprising derived and/or modified sequence from HRSV(A2)__F_DSCav1_mut4 (opt11)
  source 1..1982: mol_type = other RNA
gggagacccgtgacccggaagttgtacggctacgcgactttccctcccacaaaccctcgcgcccttcctttcctacttgggcccggcagaaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4909 - RNA, 2045 nt, synthetic construct
  misc_feature 1..2045: note = mRNA product Design h-4 comprising derived and/or modified sequence from HRSV(A2)__F_DSCav1_mut4 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4910 - RNA, 2045 nt, synthetic construct
  misc_feature 1..2045: note = mRNA product Design h-4 comprising derived and/or modified sequence from HRSV(A2)__F_DSCav1_mut4 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4911 - RNA, 2045 nt, synthetic construct
  misc_feature 1..2045: note = mRNA product Design h-4 comprising derived and/or modified sequence from HRSV(A2)__F_DSCav1_mut4 (opt2)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4912 - RNA, 2045 nt, synthetic construct
  misc_feature 1..2045: note = mRNA product Design h-4 comprising derived and/or modified sequence from HRSV(A2)__F_DSCav1_mut4 (opt3)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4913 - RNA, 2045 nt, synthetic construct
  misc_feature 1..2045: note = mRNA product Design h-4 comprising derived and/or modified sequence from HRSV(A2)__F_DSCav1_mut4 (opt4)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4914 - RNA, 2045 nt, synthetic construct
  misc_feature 1..2045: note = mRNA product Design h-4 comprising derived and/or modified sequence from HRSV(A2)__F_DSCav1_mut4 (opt5)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4915 - RNA, 2045 nt, synthetic construct
  misc_feature 1..2045: note = mRNA product Design h-4 comprising derived and/or modified sequence from HRSV(A2)__F_DSCav1_mut4 (opt6)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4916 - RNA, 2045 nt, synthetic construct
  misc_feature 1..2045: note = mRNA product Design h-4 comprising derived and/or modified sequence from HRSV(A2)__F_DSCav1_mut4 (opt11)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4917 - RNA, 2061 nt, synthetic construct
  misc_feature 1..2061: note = mRNA product Design h-5 comprising derived and/or modified sequence from HRSV(A2)__F_DSCav1_mut4 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4918 - RNA, 2061 nt, synthetic construct
  misc_feature 1..2061: note = mRNA product Design h-5 comprising derived and/or modified sequence from HRSV(A2)__F_DSCav1_mut4 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4919 - RNA, 2061 nt, synthetic construct
  misc_feature 1..2061: note = mRNA product Design h-5 comprising derived and/or modified sequence from HRSV(A2)__F_DSCav1_mut4 (opt2)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4920 - RNA, 2061 nt, synthetic construct
  misc_feature 1..2061: note = mRNA product Design h-5 comprising derived and/or modified sequence from HRSV(A2)__F_DSCav1_mut4 (opt3)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4921 - RNA, 2061 nt, synthetic construct
  misc_feature 1..2061: note = mRNA product Design h-5 comprising derived and/or modified sequence from HRSV(A2)__F_DSCav1_mut4 (opt4)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4922 - RNA, 2061 nt, synthetic construct
  misc_feature 1..2061: note = mRNA product Design h-5 comprising derived and/or modified sequence from HRSV(A2)__F_DSCav1_mut4 (opt5)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4923 - RNA, 2061 nt, synthetic construct
  misc_feature 1..2061: note = mRNA product Design h-5 comprising derived and/or modified sequence from HRSV(A2)__F_DSCav1_mut4 (opt6)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4924 - RNA, 2061 nt, synthetic construct
  misc_feature 1..2061: note = mRNA product Design h-5 comprising derived and/or modified sequence from HRSV(A2)__F_DSCav1_mut4 (opt11)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4925 - RNA, 1994 nt, synthetic construct
  misc_feature 1..1994: note = mRNA product Design i-1 comprising derived and/or modified sequence from HRSV(A2)__F_DSCav1_mut4 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4926 - RNA, 1994 nt, synthetic construct
  misc_feature 1..1994: note = mRNA product Design i-1 comprising derived and/or modified sequence from HRSV(A2)__F_DSCav1_mut4 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4927 - RNA, 1994 nt, synthetic construct
  misc_feature 1..1994: note = mRNA product Design i-1 comprising derived and/or modified sequence from HRSV(A2)__F_DSCav1_mut4 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4928 - RNA, 1994 nt, synthetic construct
  misc_feature 1..1994: note = mRNA product Design i-1 comprising derived and/or modified sequence from HRSV(A2)__F_DSCav1_mut4 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4929 - RNA, 1994 nt, synthetic construct
  misc_feature 1..1994: note = mRNA product Design i-1 comprising derived and/or modified sequence from HRSV(A2)__F_DSCav1_mut4 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4930 - RNA, 1994 nt, synthetic construct
  misc_feature 1..1994: note = mRNA product Design i-1 comprising derived and/or modified sequence from HRSV(A2)__F_DSCav1_mut4 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4931 - RNA, 1994 nt, synthetic construct
  misc_feature 1..1994: note = mRNA product Design i-1 comprising derived and/or modified sequence from HRSV(A2)__F_DSCav1_mut4 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4932 - RNA, 1994 nt, synthetic construct
  misc_feature 1..1994: note = mRNA product Design i-1 comprising derived and/or modified sequence from HRSV(A2)__F_DSCav1_mut4 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4933 - RNA, 1994 nt, synthetic construct
  misc_feature 1..1994: note = mRNA product Design i-2 comprising derived and/or modified sequence from HRSV(A2)__F_DSCav1_mut4 (opt1)
  source 1..1994: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4934 - RNA, 1994 nt, synthetic construct
  misc_feature 1..1994: note = mRNA product Design i-2 comprising derived and/or modified sequence from HRSV(A2)__F_DSCav1_mut4 (opt1)
  source 1..1994: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4935 - RNA, 1994 nt, synthetic construct
  misc_feature 1..1994: note = mRNA product Design i-2 comprising derived and/or modified sequence from HRSV(A2)__F_DSCav1_mut4 (opt2)
  source 1..1994: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4936 - RNA, 1994 nt, synthetic construct
  misc_feature 1..1994: note = mRNA product Design i-2 comprising derived and/or modified sequence from HRSV(A2)__F_DSCav1_mut4 (opt3)
  source 1..1994: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4937 - RNA, 1994 nt, synthetic construct
  misc_feature 1..1994: note = mRNA product Design i-2 comprising derived and/or modified sequence from HRSV(A2)__F_DSCav1_mut4 (opt4)
  source 1..1994: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4938 - RNA, 1994 nt, synthetic construct
  misc_feature 1..1994: note = mRNA product Design i-2 comprising derived and/or modified sequence from HRSV(A2)__F_DSCav1_mut4 (opt5)
  source 1..1994: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4939 - RNA, 1994 nt, synthetic construct
  misc_feature 1..1994: note = mRNA product Design i-2 comprising derived and/or modified sequence from HRSV(A2)__F_DSCav1_mut4 (opt6)
  source 1..1994: mol_type = other RNA
gggagaggcgctgcctacggaggtggcagccatctccttctcggcatcaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4940 - RNA, 1994 nt, synthetic construct
  misc_feature 1..1994: note = mRNA product Design i-2 comprising derived and/or modified sequence from HRSV(A2)__F_DSCav1_mut4 (opt11)
  source 1..1994: mol_type = other RNA
gggagaggcgctgcctacggaggtggcagccatctccttctcggcatcaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4941 - RNA, 1990 nt, synthetic construct
  misc_feature 1..1990: note = mRNA product Design i-2 comprising derived and/or modified sequence from HRSV(A2)__F_DSCav1_mut4 (opt1)
  source 1..1990: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4942 - RNA, 1990 nt, synthetic construct
  misc_feature 1..1990: note = mRNA product Design i-2 comprising derived and/or modified sequence from HRSV(A2)__F_DSCav1_mut4 (opt1)
  source 1..1990: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4943 - RNA, 1990 nt, synthetic construct
  misc_feature 1..1990: note = mRNA product Design i-2 comprising derived and/or modified sequence from HRSV(A2)__F_DSCav1_mut4 (opt2)
  source 1..1990: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4944 - RNA, 1990 nt, synthetic construct
  misc_feature 1..1990: note = mRNA product Design i-2 comprising derived and/or modified sequence from HRSV(A2)__F_DSCav1_mut4 (opt3)
  source 1..1990: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4945 - RNA, 1990 nt, synthetic construct
  misc_feature 1..1990: note = mRNA product Design i-2 comprising derived and/or modified sequence from HRSV(A2)__F_DSCav1_mut4 (opt4)
  source 1..1990: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4946 - RNA, 1990 nt, synthetic construct
  misc_feature 1..1990: note = mRNA product Design i-2 comprising derived and/or modified sequence from HRSV(A2)__F_DSCav1_mut4 (opt5)
  source 1..1990: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4947 - RNA, 1990 nt, synthetic construct
  misc_feature 1..1990: note = mRNA product Design i-2 comprising derived and/or modified sequence from HRSV(A2)__F_DSCav1_mut4 (opt6)
  source 1..1990: mol_type = other RNA
ggggcgctgcctacggaggtggcagccatctccttctcggcatcaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4948 - RNA, 1990 nt, synthetic construct
  misc_feature 1..1990: note = mRNA product Design i-2 comprising derived and/or modified sequence from HRSV(A2)__F_DSCav1_mut4 (opt11)
  source 1..1990: mol_type = other RNA
ggggcgctgcctacggaggtggcagccatctccttctcggcatcaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4949 - RNA, 1825 nt, synthetic construct
  misc_feature 1..1825: note = mRNA product Design i-3 comprising derived and/or modified sequence from HRSV(A2)__F_DSCav1_mut4 (opt1) R7458
  source 1..1825: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4950 - RNA, 1825 nt, synthetic construct
  misc_feature 1..1825: note = mRNA product Design i-3 comprising derived and/or modified sequence from HRSV(A2)__F_DSCav1_mut4 (opt1)
  source 1..1825: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4951 - RNA, 1825 nt, synthetic construct
  misc_feature 1..1825: note = mRNA product Design i-3 comprising derived and/or modified sequence from HRSV(A2)__F_DSCav1_mut4 (opt2)
  source 1..1825: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4952 - RNA, 1825 nt, synthetic construct
  misc_feature 1..1825: note = mRNA product Design i-3 comprising derived and/or modified sequence from HRSV(A2)__F_DSCav1_mut4 (opt3)
  source 1..1825: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctctacaccggtgaccctgagcaaggaccagctctccggcataaacaatatcgcattctcaaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4953 - RNA, 1825 nt, synthetic construct
  misc_feature 1..1825: note = mRNA product Design i-3 comprising derived and/or modified sequence from HRSV(A2)__F_DSCav1_mut4 (opt4)
  source 1..1825: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4954 - RNA, 1825 nt, synthetic construct
  misc_feature 1..1825: note = mRNA product Design i-3 comprising derived and/or modified sequence from HRSV(A2)__F_DSCav1_mut4 (opt5)
  source 1..1825: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatccacacctgtgacccttagcaaggaccagctctctgggattaacaatatcgctttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4955 - RNA, 1825 nt, synthetic construct
  misc_feature 1..1825: note = mRNA product Design i-3 comprising derived and/or modified sequence from HRSV(A2)__F_DSCav1_mut4 (opt6)
  source 1..1825: mol_type = other RNA
gggagaaagcttaccatggaacttctaatactcaaagccaacgcaataacaacaatattaacagccgtaacattttgcttcgcatcaggtcaaaacataacagaagagttctaccaatccacatgctcagcagtatcaaaaggatatttaagtgctctaagaacaggatggtacacatccgtaataacaatcgaactatcaaacataaaagaaaataaatgtaatggaacagacgccaaagtaaaattaatcaaacaagaactagacaaatacaaaaacgcagttactgaattacaattattaatgcaatcaacaccggccacaggatctggatcagcaatatgctcaggagtagcagtctgcaaagtattacacctagaaggggaagttaataaaatcaaatcagcattactatccaccaacaaagcggtagtttcactctccaacggcgtatctgtcttaacattcaaagtattagacctaaaaaactacattgacaaacaactactaccaatcctaaacaaacaatcatgttccataagcaatatagaaacagtaatagaatttcaacaaaaaaacaacagactattagaaataacaagagaattttccgtcaatgcaggagttactacccctgtctccacctatatgctaaccaattccgaactcttatcattaataaacgacatgcctatcacaaatgaccaaaaaaaattaatgagcaacaacgtacaaatagtacgacaacaatcatactcaatcatgtgcataataaaagaagaagtcctagcatacgttgtacaactaccactatacggagtcatagataccccatgctggaaactccatacaagcccactatgcactacaaacacaaaagaaggctctaatatatgtctaacaagaacagaccgaggatggtactgcgataatgccggctcagtctcattctttccgcaagccgaaacttgtaaagtacaaagtaacagagtattttgtgacaccatgaactcaagaaccctcccaagcgaagtcaatctatgcaacgttgatatattcaatcccaaatacgactgcaaaatcatgacctcaaaaacagacgtcagctcatccgttataacatcactaggagccatcgtatcttgctatggaaaaacaaaatgcacagcaagcaataaaaacagaggcataataaaaacattctcaaatggatgcgactacgtatcaaacaaaggagtcgacacagtttccgtaggaaacactttatactgcgtaaacaaacaagaaggaaaatcattatacgtcaaaggtgaaccaataataaacttctacgatccacttgtattcccatcagacgaatttgacgcatcaatttcacaagtaaacgaaaaaataaaccaatcactcgcattcataagaaaatcagatgaactactacataacgtaaacgcaggaaaatccacaacaaacatcatgataacaaccatcataatcgtaataatcgtaatactattatccctaattgcagtaggattactcttatattgcaaagcaagatcaacaccagtaaccctcagtaaagaccaactatccggaataaataacatcgcattctcaaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4956 - RNA, 1825 nt, synthetic construct
  misc_feature 1..1825: note = mRNA product Design i-3 comprising derived and/or modified sequence from HRSV(A2)__F_DSCav1_mut4 (opt11)
  source 1..1825: mol_type = other RNA
gggagaaagcttaccatggaactgctcatcctcaaagccaacgccatcaccaccattcttaccgccgtcacattctgcttcgcctcaggccaaaacatcaccgaagaattttaccaatccacttgttcagccgtctcaaaaggatacctatcagccctccgtaccggctggtacacctcggtcataacaatagaactctccaacataaaagaaaacaaatgcaacggcaccgacgccaaggtcaaactgataaaacaagaacttgataaatacaaaaacgccgtcactgaactccaactcctcatgcaatccactcccgctactggctctggctccgccatctgctctggcgtcgccgtctgtaaagtactccacctcgaaggggaagtcaacaaaatcaaatcagccctccttagcaccaacaaggccgtcgtctccctctcaaacggagtcagcgtcctcaccttcaaggtcctcgacctcaagaactacatcgacaaacaactcctgcccatcctaaataaacaatcctgctctatctccaatatcgaaaccgttatagagttccaacagaaaaacaaccgactcctcgaaatcacccgcgagttctccgtcaacgcaggcgtcaccacccctgtgtcaacctacatgctcaccaacagcgaactactctcactcatcaatgacatgcccatcaccaacgaccaaaagaaactcatgtccaacaacgtccaaatcgtacgtcaacaatcctacagcatcatgtgcatcataaaagaagaagtcctcgcctacgtcgtccaacttcccctctacggcgtcatagacaccccctgctggaaactgcatacctcacccctatgcaccaccaacactaaagaaggctccaacatctgcctcacccgcacggaccgcggctggtactgcgacaacgccggctccgtctccttcttcccccaagccgaaacttgtaaagtccaatccaacagagtcttctgcgacaccatgaactctagaacgctgccatccgaggtaaacctatgcaacgtcgacatcttcaatcccaaatacgactgcaagatcatgacctcaaaaaccgacgtatcctcctcagtaatcaccagtctcggagctatcgtctcctgctacggcaaaaccaaatgcacggcctctaacaaaaaccgcggcatcatcaaaaccttctcaaacggatgcgactacgtcagcaacaaaggcgtagataccgtctctgtcggcaacacactgtactgcgtaaacaagcaagaaggaaaatccctctacgtaaaaggcgaacccatcatcaacttctacgaccccctcgttttcccctcagatgaatttgacgcctcgatatcacaagtcaacgaaaagataaatcagtccctcgccttcatccgaaaatccgacgaactcctccacaacgttaacgcaggaaagtccaccacaaacatcatgataactacaatcataatagtcattatcgtcatactcctctccctaatcgccgtaggcctgctactctactgcaaagcccgctcaacccccgtcactctctcaaaagaccaactctccggcatcaataacatcgccttctcaaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4957 - protein, 514 aa, synthetic construct
  REGION 1..514: note = derived and/or modified protein sequence (artificial) from HRSV(A2)__F-del_DSCav1_mut4
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATGSGSAICSGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYCVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 4958 - RNA, 1545 nt, synthetic construct
  misc_feature 1..1545: note = derived and/or modified CDS sequence (opt1) from HRSV(A2)__F-del_DSCav1_mut4
  source 1..1545: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtga

SEQ ID NO: 4959 - RNA, 1545 nt, synthetic construct
  misc_feature 1..1545: note = derived and/or modified CDS sequence (opt1) from HRSV(A2)__F-del_DSCav1_mut4
  source 1..1545: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtga

SEQ ID NO: 4960 - RNA, 1545 nt, synthetic construct
  misc_feature 1..1545: note = derived and/or modified CDS sequence (opt2) from HRSV(A2)__F-del_DSCav1_mut4
  source 1..1545: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctga

SEQ ID NO: 4961 - RNA, 1545 nt, synthetic construct
  misc_feature 1..1545: note = derived and/or modified CDS sequence (opt3) from HRSV(A2)__F-del_DSCav1_mut4
  source 1..1545: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctga

SEQ ID NO: 4962 - RNA, 1545 nt, synthetic construct
  misc_feature 1..1545: note = derived and/or modified CDS sequence (opt4) from HRSV(A2)__F-del_DSCav1_mut4
  source 1..1545: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatga

SEQ ID NO: 4963 - RNA, 1545 nt, synthetic construct
  misc_feature 1..1545: note = derived and/or modified CDS sequence (opt5) from HRSV(A2)__F-del_DSCav1_mut4
  source 1..1545: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatga

SEQ ID NO: 4964 - RNA, 1545 nt, synthetic construct
  misc_feature 1..1545: note = derived and/or modified CDS sequence (opt6) from HRSV(A2)__F-del_DSCav1_mut4
  source 1..1545: mol_type = other RNA
atggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaa

SEQ ID NO: 4965 - RNA, 1545 nt, synthetic construct
  misc_feature 1..1545: note = derived and/or modified CDS sequence (opt11) from HRSV(A2)__F-del_DSCav1_mut4
  source 1..1545: mol_type = other RNA
atggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaa

SEQ ID NO: 4966 - RNA, 1821 nt, synthetic construct
  misc_feature 1..1821: note = mRNA product Design a-1 comprising derived and/or modified sequence from HRSV(A2)__F-del_DSCav1_mut4 (opt1)
  source 1..1821: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4967 - RNA, 1821 nt, synthetic construct
  misc_feature 1..1821: note = mRNA product Design a-1 comprising derived and/or modified sequence from HRSV(A2)__F-del_DSCav1_mut4 (opt1)
  source 1..1821: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4968 - RNA, 1821 nt, synthetic construct
  misc_feature 1..1821: note = mRNA product Design a-1 comprising derived and/or modified sequence from HRSV(A2)__F-del_DSCav1_mut4 (opt2)
  source 1..1821: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4969 - RNA, 1821 nt, synthetic construct
  misc_feature 1..1821: note = mRNA product Design a-1 comprising derived and/or modified sequence from HRSV(A2)__F-del_DSCav1_mut4 (opt3)
  source 1..1821: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4970 - RNA, 1821 nt, synthetic construct
  misc_feature 1..1821: note = mRNA product Design a-1 comprising derived and/or modified sequence from HRSV(A2)__F-del_DSCav1_mut4 (opt4)
  source 1..1821: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4971 - RNA, 1821 nt, synthetic construct
  misc_feature 1..1821: note = mRNA product Design a-1 comprising derived and/or modified sequence from HRSV(A2)__F-del_DSCav1_mut4 (opt5)
  source 1..1821: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4972 - RNA, 1821 nt, synthetic construct
  misc_feature 1..1821: note = mRNA product Design a-1 comprising derived and/or modified sequence from HRSV(A2)__F-del_DSCav1_mut4 (opt6)
  source 1..1821: mol_type = other RNA
gggagagtcccgcagtcggcgtccagcggctctgcttgttcgtgtgtgtgtcgttgcaggccttattcaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4973 - RNA, 1821 nt, synthetic construct
  misc_feature 1..1821: note = mRNA product Design a-1 comprising derived and/or modified sequence from HRSV(A2)__F-del_DSCav1_mut4 (opt11)
  source 1..1821: mol_type = other RNA
gggagagtcccgcagtcggcgtccagcggctctgcttgttcgtgtgtgtgtcgttgcaggccttattcaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4974 - RNA, 1840 nt, synthetic construct
  misc_feature 1..1840: note = mRNA product Design a-2 comprising derived and/or modified sequence from HRSV(A2)__F-del_DSCav1_mut4 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4975 - RNA, 1840 nt, synthetic construct
  misc_feature 1..1840: note = mRNA product Design a-2 comprising derived and/or modified sequence from HRSV(A2)__F-del_DSCav1_mut4 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4976 - RNA, 1840 nt, synthetic construct
  misc_feature 1..1840: note = mRNA product Design a-2 comprising derived and/or modified sequence from HRSV(A2)__F-del_DSCav1_mut4 (opt2)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4977 - RNA, 1840 nt, synthetic construct
  misc_feature 1..1840: note = mRNA product Design a-2 comprising derived and/or modified sequence from HRSV(A2)__F-del_DSCav1_mut4 (opt3)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4978 - RNA, 1840 nt, synthetic construct
  misc_feature 1..1840: note = mRNA product Design a-2 comprising derived and/or modified sequence from HRSV(A2)__F-del_DSCav1_mut4 (opt4)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4979 - RNA, 1840 nt, synthetic construct
  misc_feature 1..1840: note = mRNA product Design a-2 comprising derived and/or modified sequence from HRSV(A2)__F-del_DSCav1_mut4 (opt5)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4980 - RNA, 1840 nt, synthetic construct
  misc_feature 1..1840: note = mRNA product Design a-2 comprising derived and/or modified sequence from HRSV(A2)__F-del_DSCav1_mut4 (opt6)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4981 - RNA, 1840 nt, synthetic construct
  misc_feature 1..1840: note = mRNA product Design a-2 comprising derived and/or modified sequence from HRSV(A2)__F-del_DSCav1_mut4 (opt11)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4982 - RNA, 1918 nt, synthetic construct
  misc_feature 1..1918: note = mRNA product Design a-3 comprising derived and/or modified sequence from HRSV(A2)__F-del_DSCav1_mut4 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4983 - RNA, 1918 nt, synthetic construct
  misc_feature 1..1918: note = mRNA product Design a-3 comprising derived and/or modified sequence from HRSV(A2)__F-del_DSCav1_mut4 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4984 - RNA, 1918 nt, synthetic construct
  misc_feature 1..1918: note = mRNA product Design a-3 comprising derived and/or modified sequence from HRSV(A2)__F-del_DSCav1_mut4 (opt2)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4985 - RNA, 1918 nt, synthetic construct
  misc_feature 1..1918: note = mRNA product Design a-3 comprising derived and/or modified sequence from HRSV(A2)__F-del_DSCav1_mut4 (opt3)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4986 - RNA, 1918 nt, synthetic construct
  misc_feature 1..1918: note = mRNA product Design a-3 comprising derived and/or modified sequence from HRSV(A2)__F-del_DSCav1_mut4 (opt4)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4987 - RNA, 1918 nt, synthetic construct
  misc_feature 1..1918: note = mRNA product Design a-3 comprising derived and/or modified sequence from HRSV(A2)__F-del_DSCav1_mut4 (opt5)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4988 - RNA, 1918 nt, synthetic construct
  misc_feature 1..1918: note = mRNA product Design a-3 comprising derived and/or modified sequence from HRSV(A2)__F-del_DSCav1_mut4 (opt6)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4989 - RNA, 1918 nt, synthetic construct
  misc_feature 1..1918: note = mRNA product Design a-3 comprising derived and/or modified sequence from HRSV(A2)__F-del_DSCav1_mut4 (opt11)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4990 - RNA, 1867 nt, synthetic construct
  misc_feature 1..1867: note = mRNA product Design a-4 comprising derived and/or modified sequence from HRSV(A2)__F-del_DSCav1_mut4 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4991 - RNA, 1867 nt, synthetic construct
  misc_feature 1..1867: note = mRNA product Design a-4 comprising derived and/or modified sequence from HRSV(A2)__F-del_DSCav1_mut4 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4992 - RNA, 1867 nt, synthetic construct
  misc_feature 1..1867: note = mRNA product Design a-4 comprising derived and/or modified sequence from HRSV(A2)__F-del_DSCav1_mut4 (opt2)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4993 - RNA, 1867 nt, synthetic construct
  misc_feature 1..1867: note = mRNA product Design a-4 comprising derived and/or modified sequence from HRSV(A2)__F-del_DSCav1_mut4 (opt3)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4994 - RNA, 1867 nt, synthetic construct
  misc_feature 1..1867: note = mRNA product Design a-4 comprising derived and/or modified sequence from HRSV(A2)__F-del_DSCav1_mut4 (opt4)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4995 - RNA, 1867 nt, synthetic construct
  misc_feature 1..1867: note = mRNA product Design a-4 comprising derived and/or modified sequence from HRSV(A2)__F-del_DSCav1_mut4 (opt5)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4996 - RNA, 1867 nt, synthetic construct
  misc_feature 1..1867: note = mRNA product Design a-4 comprising derived and/or modified sequence from HRSV(A2)__F-del_DSCav1_mut4 (opt6)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4997 - RNA, 1867 nt, synthetic construct
  misc_feature 1..1867: note = mRNA product Design a-4 comprising derived and/or modified sequence from HRSV(A2)__F-del_DSCav1_mut4 (opt11)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4998 - RNA, 1813 nt, synthetic construct
  misc_feature 1..1813: note = mRNA product Design a-5 comprising derived and/or modified sequence from HRSV(A2)__F-del_DSCav1_mut4 (opt1)
  source 1..1813: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4999 - RNA, 1813 nt, synthetic construct
  misc_feature 1..1813: note = mRNA product Design a-5 comprising derived and/or modified sequence from HRSV(A2)__F-del_DSCav1_mut4 (opt1)
  source 1..1813: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5000 - RNA, 1813 nt, synthetic construct
  misc_feature 1..1813: note = mRNA product Design a-5 comprising derived and/or modified sequence from HRSV(A2)__F-del_DSCav1_mut4 (opt2)
  source 1..1813: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5001 - RNA, 1813 nt, synthetic construct
  misc_feature 1..1813: note = mRNA product Design a-5 comprising derived and/or modified sequence from HRSV(A2)__F-del_DSCav1_mut4 (opt3)
  source 1..1813: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5002 - RNA, 1813 nt, synthetic construct
  misc_feature 1..1813: note = mRNA product Design a-5 comprising derived and/or modified sequence from HRSV(A2)__F-del_DSCav1_mut4 (opt4)
  source 1..1813: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5003 - RNA, 1813 nt, synthetic construct
  misc_feature 1..1813: note = mRNA product Design a-5 comprising derived and/or modified sequence from HRSV(A2)__F-del_DSCav1_mut4 (opt5)
  source 1..1813: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5004 - RNA, 1813 nt, synthetic construct
  misc_feature 1..1813: note = mRNA product Design a-5 comprising derived and/or modified sequence from HRSV(A2)__F-del_DSCav1_mut4 (opt6)
  source 1..1813: mol_type = other RNA
gggagactttcccattctgtagcagaatttggtgttgcctgtggtcttggtcccgcggagaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5005 - RNA, 1813 nt, synthetic construct
  misc_feature 1..1813: note = mRNA product Design a-5 comprising derived and/or modified sequence from HRSV(A2)__F-del_DSCav1_mut4 (opt11)
  source 1..1813: mol_type = other RNA
gggagactttcccattctgtagcagaatttggtgttgcctgtggtcttggtcccgcggagaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5006 - RNA, 1994 nt, synthetic construct
  misc_feature 1..1994: note = mRNA product Design b-1 comprising derived and/or modified sequence from HRSV(A2)__F-del_DSCav1_mut4 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5007 - RNA, 1994 nt, synthetic construct
  misc_feature 1..1994: note = mRNA product Design b-1 comprising derived and/or modified sequence from HRSV(A2)__F-del_DSCav1_mut4 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5008 - RNA, 1994 nt, synthetic construct
  misc_feature 1..1994: note = mRNA product Design b-1 comprising derived and/or modified sequence from HRSV(A2)__F-del_DSCav1_mut4 (opt2)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5009 - RNA, 1994 nt, synthetic construct
  misc_feature 1..1994: note = mRNA product Design b-1 comprising derived and/or modified sequence from HRSV(A2)__F-del_DSCav1_mut4 (opt3)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5010 - RNA, 1994 nt, synthetic construct
  misc_feature 1..1994: note = mRNA product Design b-1 comprising derived and/or modified sequence from HRSV(A2)__F-del_DSCav1_mut4 (opt4)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5011 - RNA, 1994 nt, synthetic construct
  misc_feature 1..1994: note = mRNA product Design b-1 comprising derived and/or modified sequence from HRSV(A2)__F-del_DSCav1_mut4 (opt5)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5012 - RNA, 1994 nt, synthetic construct
  misc_feature 1..1994: note = mRNA product Design b-1 comprising derived and/or modified sequence from HRSV(A2)__F-del_DSCav1_mut4 (opt6)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5013 - RNA, 1994 nt, synthetic construct
  misc_feature 1..1994: note = mRNA product Design b-1 comprising derived and/or modified sequence from HRSV(A2)__F-del_DSCav1_mut4 (opt11)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5014 - RNA, 1814 nt, synthetic construct
  misc_feature 1..1814: note = mRNA product Design b-2 comprising derived and/or modified sequence from HRSV(A2)__F-del_DSCav1_mut4 (opt1)
  source 1..1814: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5015 - RNA, 1814 nt, synthetic construct
  misc_feature 1..1814: note = mRNA product Design b-2 comprising derived and/or modified sequence from HRSV(A2)__F-del_DSCav1_mut4 (opt1)
  source 1..1814: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5016 - RNA, 1814 nt, synthetic construct
  misc_feature 1..1814: note = mRNA product Design b-2 comprising derived and/or modified sequence from HRSV(A2)__F-del_DSCav1_mut4 (opt2)
  source 1..1814: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5017 - RNA, 1814 nt, synthetic construct
  misc_feature 1..1814: note = mRNA product Design b-2 comprising derived and/or modified sequence from HRSV(A2)__F-del_DSCav1_mut4 (opt3)
  source 1..1814: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5018 - RNA, 1814 nt, synthetic construct
  misc_feature 1..1814: note = mRNA product Design b-2 comprising derived and/or modified sequence from HRSV(A2)__F-del_DSCav1_mut4 (opt4)
  source 1..1814: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5019 - RNA, 1814 nt, synthetic construct
  misc_feature 1..1814: note = mRNA product Design b-2 comprising derived and/or modified sequence from HRSV(A2)__F-del_DSCav1_mut4 (opt5)
  source 1..1814: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5020 - RNA, 1814 nt, synthetic construct
  misc_feature 1..1814: note = mRNA product Design b-2 comprising derived and/or modified sequence from HRSV(A2)__F-del_DSCav1_mut4 (opt6)
  source 1..1814: mol_type = other RNA
gggagagcctctgctggagtccggggagtggcgttggctgctagagcgaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5021 - RNA, 1814 nt, synthetic construct
  misc_feature 1..1814: note = mRNA product Design b-2 comprising derived and/or modified sequence from HRSV(A2)__F-del_DSCav1_mut4 (opt11)
  source 1..1814: mol_type = other RNA
gggagagcctctgctggagtccggggagtggcgttggctgctagagcgaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5022 - RNA, 1834 nt, synthetic construct
  misc_feature 1..1834: note = mRNA product Design b-3 comprising derived and/or modified sequence from HRSV(A2)__F-del_DSCav1_mut4 (opt1)
  source 1..1834: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5023 - RNA, 1834 nt, synthetic construct
  misc_feature 1..1834: note = mRNA product Design b-3 comprising derived and/or modified sequence from HRSV(A2)__F-del_DSCav1_mut4 (opt1)
  source 1..1834: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5024 - RNA, 1834 nt, synthetic construct
  misc_feature 1..1834: note = mRNA product Design b-3 comprising derived and/or modified sequence from HRSV(A2)__F-del_DSCav1_mut4 (opt2)
  source 1..1834: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5025 - RNA, 1834 nt, synthetic construct
  misc_feature 1..1834: note = mRNA product Design b-3 comprising derived and/or modified sequence from HRSV(A2)__F-del_DSCav1_mut4 (opt3)
  source 1..1834: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5026 - RNA, 1834 nt, synthetic construct
  misc_feature 1..1834: note = mRNA product Design b-3 comprising derived and/or modified sequence from HRSV(A2)__F-del_DSCav1_mut4 (opt4)
  source 1..1834: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5027 - RNA, 1834 nt, synthetic construct
  misc_feature 1..1834: note = mRNA product Design b-3 comprising derived and/or modified sequence from HRSV(A2)__F-del_DSCav1_mut4 (opt5)
  source 1..1834: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5028 - RNA, 1834 nt, synthetic construct
  misc_feature 1..1834: note = mRNA product Design b-3 comprising derived and/or modified sequence from HRSV(A2)__F-del_DSCav1_mut4 (opt6)
  source 1..1834: mol_type = other RNA
gggagagtcccgcagtcggcgtccagcggctctgcttgttcgtgtgtgtgtcgttgcaggccttattcaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5029 - RNA, 1834 nt, synthetic construct
  misc_feature 1..1834: note = mRNA product Design b-3 comprising derived and/or modified sequence from HRSV(A2)__F-del_DSCav1_mut4 (opt11)
  source 1..1834: mol_type = other RNA
gggagagtcccgcagtcggcgtccagcggctctgcttgttcgtgtgtgtgtcgttgcaggccttattcaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5030 - RNA, 1885 nt, synthetic construct
  misc_feature 1..1885: note = mRNA product Design b-4 comprising derived and/or modified sequence from HRSV(A2)__F-del_DSCav1_mut4 (opt1)
  source 1..1885: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5031 - RNA, 1885 nt, synthetic construct
  misc_feature 1..1885: note = mRNA product Design b-4 comprising derived and/or modified sequence from HRSV(A2)__F-del_DSCav1_mut4 (opt1)
  source 1..1885: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5032 - RNA, 1885 nt, synthetic construct
  misc_feature 1..1885: note = mRNA product Design b-4 comprising derived and/or modified sequence from HRSV(A2)__F-del_DSCav1_mut4 (opt2)
  source 1..1885: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5033 - RNA, 1885 nt, synthetic construct
  misc_feature 1..1885: note = mRNA product Design b-4 comprising derived and/or modified sequence from HRSV(A2)__F-del_DSCav1_mut4 (opt3)
  source 1..1885: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5034 - RNA, 1885 nt, synthetic construct
  misc_feature 1..1885: note = mRNA product Design b-4 comprising derived and/or modified sequence from HRSV(A2)__F-del_DSCav1_mut4 (opt4)
  source 1..1885: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5035 - RNA, 1885 nt, synthetic construct
  misc_feature 1..1885: note = mRNA product Design b-4 comprising derived and/or modified sequence from HRSV(A2)__F-del_DSCav1_mut4 (opt5)
  source 1..1885: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5036 - RNA, 1885 nt, synthetic construct
  misc_feature 1..1885: note = mRNA product Design b-4 comprising derived and/or modified sequence from HRSV(A2)__F-del_DSCav1_mut4 (opt6)
  source 1..1885: mol_type = other RNA
gggagagtcccgcagtcggcgtccagcggctctgcttgttcgtgtgtgtgtcgttgcaggccttattcaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5037 - RNA, 1885 nt, synthetic construct
  misc_feature 1..1885: note = mRNA product Design b-4 comprising derived and/or modified sequence from HRSV(A2)__F-del_DSCav1_mut4 (opt11)
  source 1..1885: mol_type = other RNA
gggagagtcccgcagtcggcgtccagcggctctgcttgttcgtgtgtgtgtcgttgcaggccttattcaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5038 - RNA, 1947 nt, synthetic construct
  misc_feature 1..1947: note = mRNA product Design b-5 comprising derived and/or modified sequence from HRSV(A2)__F-del_DSCav1_mut4 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5039 - RNA, 1947 nt, synthetic construct
  misc_feature 1..1947: note = mRNA product Design b-5 comprising derived and/or modified sequence from HRSV(A2)__F-del_DSCav1_mut4 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5040 - RNA, 1947 nt, synthetic construct
  misc_feature 1..1947: note = mRNA product Design b-5 comprising derived and/or modified sequence from HRSV(A2)__F-del_DSCav1_mut4 (opt2)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5041 - RNA, 1947 nt, synthetic construct
  misc_feature 1..1947: note = mRNA product Design b-5 comprising derived and/or modified sequence from HRSV(A2)__F-del_DSCav1_mut4 (opt3)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5042 - RNA, 1947 nt, synthetic construct
  misc_feature 1..1947: note = mRNA product Design b-5 comprising derived and/or modified sequence from HRSV(A2)__F-del_DSCav1_mut4 (opt4)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5043 - RNA, 1947 nt, synthetic construct
  misc_feature 1..1947: note = mRNA product Design b-5 comprising derived and/or modified sequence from HRSV(A2)__F-del_DSCav1_mut4 (opt5)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5044 - RNA, 1947 nt, synthetic construct
  misc_feature 1..1947: note = mRNA product Design b-5 comprising derived and/or modified sequence from HRSV(A2)__F-del_DSCav1_mut4 (opt6)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5045 - RNA, 1947 nt, synthetic construct
  misc_feature 1..1947: note = mRNA product Design b-5 comprising derived and/or modified sequence from HRSV(A2)__F-del_DSCav1_mut4 (opt11)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5046 - RNA, 1853 nt, synthetic construct
  misc_feature 1..1853: note = mRNA product Design c-1 comprising derived and/or modified sequence from HRSV(A2)__F-del_DSCav1_mut4 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5047 - RNA, 1853 nt, synthetic construct
  misc_feature 1..1853: note = mRNA product Design c-1 comprising derived and/or modified sequence from HRSV(A2)__F-del_DSCav1_mut4 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5048 - RNA, 1853 nt, synthetic construct
  misc_feature 1..1853: note = mRNA product Design c-1 comprising derived and/or modified sequence from HRSV(A2)__F-del_DSCav1_mut4 (opt2)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5049 - RNA, 1853 nt, synthetic construct
  misc_feature 1..1853: note = mRNA product Design c-1 comprising derived and/or modified sequence from HRSV(A2)__F-del_DSCav1_mut4 (opt3)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5050 - RNA, 1853 nt, synthetic construct
  misc_feature 1..1853: note = mRNA product Design c-1 comprising derived and/or modified sequence from HRSV(A2)__F-del_DSCav1_mut4 (opt4)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5051 - RNA, 1853 nt, synthetic construct
  misc_feature 1..1853: note = mRNA product Design c-1 comprising derived and/or modified sequence from HRSV(A2)__F-del_DSCav1_mut4 (opt5)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5052 - RNA, 1853 nt, synthetic construct
  misc_feature 1..1853: note = mRNA product Design c-1 comprising derived and/or modified sequence from HRSV(A2)__F-del_DSCav1_mut4 (opt6)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5053 - RNA, 1853 nt, synthetic construct
  misc_feature 1..1853: note = mRNA product Design c-1 comprising derived and/or modified sequence from HRSV(A2)__F-del_DSCav1_mut4 (opt11)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5054 - RNA, 1943 nt, synthetic construct
  misc_feature 1..1943: note = mRNA product Design c-2 comprising derived and/or modified sequence from HRSV(A2)__F-del_DSCav1_mut4 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5055 - RNA, 1943 nt, synthetic construct
  misc_feature 1..1943: note = mRNA product Design c-2 comprising derived and/or modified sequence from HRSV(A2)__F-del_DSCav1_mut4 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5056 - RNA, 1943 nt, synthetic construct
  misc_feature 1..1943: note = mRNA product Design c-2 comprising derived and/or modified sequence from HRSV(A2)__F-del_DSCav1_mut4 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5057 - RNA, 1943 nt, synthetic construct
  misc_feature 1..1943: note = mRNA product Design c-2 comprising derived and/or modified sequence from HRSV(A2)__F-del_DSCav1_mut4 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5058 - RNA, 1943 nt, synthetic construct
  misc_feature 1..1943: note = mRNA product Design c-2 comprising derived and/or modified sequence from HRSV(A2)__F-del_DSCav1_mut4 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5059 - RNA, 1943 nt, synthetic construct
  misc_feature 1..1943: note = mRNA product Design c-2 comprising derived and/or modified sequence from HRSV(A2)__F-del_DSCav1_mut4 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5060 - RNA, 1943 nt, synthetic construct
  misc_feature 1..1943: note = mRNA product Design c-2 comprising derived and/or modified sequence from HRSV(A2)__F-del_DSCav1_mut4 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5061 - RNA, 1943 nt, synthetic construct
  misc_feature 1..1943: note = mRNA product Design c-2 comprising derived and/or modified sequence from HRSV(A2)__F-del_DSCav1_mut4 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5062 - RNA, 1920 nt, synthetic construct
  misc_feature 1..1920: note = mRNA product Design c-3 comprising derived and/or modified sequence from HRSV(A2)__F-del_DSCav1_mut4 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5063 - RNA, 1920 nt, synthetic construct
  misc_feature 1..1920: note = mRNA product Design c-3 comprising derived and/or modified sequence from HRSV(A2)__F-del_DSCav1_mut4 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5064 - RNA, 1920 nt, synthetic construct
  misc_feature 1..1920: note = mRNA product Design c-3 comprising derived and/or modified sequence from HRSV(A2)__F-del_DSCav1_mut4 (opt2)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5065 - RNA, 1920 nt, synthetic construct
  misc_feature 1..1920: note = mRNA product Design c-3 comprising derived and/or modified sequence from HRSV(A2)__F-del_DSCav1_mut4 (opt3)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5066 - RNA, 1920 nt, synthetic construct
  misc_feature 1..1920: note = mRNA product Design c-3 comprising derived and/or modified sequence from HRSV(A2)__F-del_DSCav1_mut4 (opt4)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5067 - RNA, 1920 nt, synthetic construct
  misc_feature 1..1920: note = mRNA product Design c-3 comprising derived and/or modified sequence from HRSV(A2)__F-del_DSCav1_mut4 (opt5)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5068 - RNA, 1920 nt, synthetic construct
  misc_feature 1..1920: note = mRNA product Design c-3 comprising derived and/or modified sequence from HRSV(A2)__F-del_DSCav1_mut4 (opt6)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5069 - RNA, 1920 nt, synthetic construct
  misc_feature 1..1920: note = mRNA product Design c-3 comprising derived and/or modified sequence from HRSV(A2)__F-del_DSCav1_mut4 (opt11)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5070 - RNA, 1916 nt, synthetic construct
  misc_feature 1..1916: note = mRNA product Design c-4 comprising derived and/or modified sequence from HRSV(A2)__F-del_DSCav1_mut4 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5071 - RNA, 1916 nt, synthetic construct
  misc_feature 1..1916: note = mRNA product Design c-4 comprising derived and/or modified sequence from HRSV(A2)__F-del_DSCav1_mut4 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5072 - RNA, 1916 nt, synthetic construct
  misc_feature 1..1916: note = mRNA product Design c-4 comprising derived and/or modified sequence from HRSV(A2)__F-del_DSCav1_mut4 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5073 - RNA, 1916 nt, synthetic construct
  misc_feature 1..1916: note = mRNA product Design c-4 comprising derived and/or modified sequence from HRSV(A2)__F-del_DSCav1_mut4 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5074 - RNA, 1916 nt, synthetic construct
  misc_feature 1..1916: note = mRNA product Design c-4 comprising derived and/or modified sequence from HRSV(A2)__F-del_DSCav1_mut4 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5075 - RNA, 1916 nt, synthetic construct
  misc_feature 1..1916: note = mRNA product Design c-4 comprising derived and/or modified sequence from HRSV(A2)__F-del_DSCav1_mut4 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5076 - RNA, 1916 nt, synthetic construct
  misc_feature 1..1916: note = mRNA product Design c-4 comprising derived and/or modified sequence from HRSV(A2)__F-del_DSCav1_mut4 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5077 - RNA, 1916 nt, synthetic construct
  misc_feature 1..1916: note = mRNA product Design c-4 comprising derived and/or modified sequence from HRSV(A2)__F-del_DSCav1_mut4 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5078 - RNA, 1834 nt, synthetic construct
  misc_feature 1..1834: note = mRNA product Design c-5 comprising derived and/or modified sequence from HRSV(A2)__F-del_DSCav1_mut4 (opt1)
  source 1..1834: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5079 - RNA, 1834 nt, synthetic construct
  misc_feature 1..1834: note = mRNA product Design c-5 comprising derived and/or modified sequence from HRSV(A2)__F-del_DSCav1_mut4 (opt1)
  source 1..1834: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5080 - RNA, 1834 nt, synthetic construct
  misc_feature 1..1834: note = mRNA product Design c-5 comprising derived and/or modified sequence from HRSV(A2)__F-del_DSCav1_mut4 (opt2)
  source 1..1834: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5081 - RNA, 1834 nt, synthetic construct
  misc_feature 1..1834: note = mRNA product Design c-5 comprising derived and/or modified sequence from HRSV(A2)__F-del_DSCav1_mut4 (opt3)
  source 1..1834: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5082 - RNA, 1834 nt, synthetic construct
  misc_feature 1..1834: note = mRNA product Design c-5 comprising derived and/or modified sequence from HRSV(A2)__F-del_DSCav1_mut4 (opt4)
  source 1..1834: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5083 - RNA, 1834 nt, synthetic construct
  misc_feature 1..1834: note = mRNA product Design c-5 comprising derived and/or modified sequence from HRSV(A2)__F-del_DSCav1_mut4 (opt5)
  source 1..1834: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5084 - RNA, 1834 nt, synthetic construct
  misc_feature 1..1834: note = mRNA product Design c-5 comprising derived and/or modified sequence from HRSV(A2)__F-del_DSCav1_mut4 (opt6)
  source 1..1834: mol_type = other RNA
gggagagcggctcggccattttgtcccagtcagtccggaggctgcggctgcagaagtaccgcctgcggagtaactgcaaagaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5085 - RNA, 1834 nt, synthetic construct
  misc_feature 1..1834: note = mRNA product Design c-5 comprising derived and/or modified sequence from HRSV(A2)__F-del_DSCav1_mut4 (opt11)
  source 1..1834: mol_type = other RNA
gggagagcggctcggccattttgtcccagtcagtccggaggctgcggctgcagaagtaccgcctgcggagtaactgcaaagaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5086 - RNA, 1843 nt, synthetic construct
  misc_feature 1..1843: note = mRNA product Design d-1 comprising derived and/or modified sequence from HRSV(A2)__F-del_DSCav1_mut4 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5087 - RNA, 1843 nt, synthetic construct
  misc_feature 1..1843: note = mRNA product Design d-1 comprising derived and/or modified sequence from HRSV(A2)__F-del_DSCav1_mut4 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5088 - RNA, 1843 nt, synthetic construct
  misc_feature 1..1843: note = mRNA product Design d-1 comprising derived and/or modified sequence from HRSV(A2)__F-del_DSCav1_mut4 (opt2)
  source 1..1843: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5089 - RNA, 1843 nt, synthetic construct
  misc_feature 1..1843: note = mRNA product Design d-1 comprising derived and/or modified sequence from HRSV(A2)__F-del_DSCav1_mut4 (opt3)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5090 - RNA, 1843 nt, synthetic construct
  misc_feature 1..1843: note = mRNA product Design d-1 comprising derived and/or modified sequence from HRSV(A2)__F-del_DSCav1_mut4 (opt4)
  source 1..1843: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5091 - RNA, 1843 nt, synthetic construct
  misc_feature 1..1843: note = mRNA product Design d-1 comprising derived and/or modified sequence from HRSV(A2)__F-del_DSCav1_mut4 (opt5)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5092 - RNA, 1843 nt, synthetic construct
  misc_feature 1..1843: note = mRNA product Design d-1 comprising derived and/or modified sequence from HRSV(A2)__F-del_DSCav1_mut4 (opt6)
  source 1..1843: mol_type = other RNA
gggagacccgtgacccggaagttgtacggctacgcgactttccctcccacaaaccctcgcgcccttcctttcctacttgggcccggcagaaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5093 - RNA, 1843 nt, synthetic construct
  misc_feature 1..1843: note = mRNA product Design d-1 comprising derived and/or modified sequence from HRSV(A2)__F-del_DSCav1_mut4 (opt11)
  source 1..1843: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5094 - RNA, 1898 nt, synthetic construct
  misc_feature 1..1898: note = mRNA product Design d-2 comprising derived and/or modified sequence from HRSV(A2)__F-del_DSCav1_mut4 (opt1)
  source 1..1898: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5095 - RNA, 1898 nt, synthetic construct
  misc_feature 1..1898: note = mRNA product Design d-2 comprising derived and/or modified sequence from HRSV(A2)__F-del_DSCav1_mut4 (opt1)
  source 1..1898: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5096 - RNA, 1898 nt, synthetic construct
  misc_feature 1..1898: note = mRNA product Design d-2 comprising derived and/or modified sequence from HRSV(A2)__F-del_DSCav1_mut4 (opt2)
  source 1..1898: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5097 - RNA, 1898 nt, synthetic construct
  misc_feature 1..1898: note = mRNA product Design d-2 comprising derived and/or modified sequence from HRSV(A2)__F-del_DSCav1_mut4 (opt3)
  source 1..1898: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5098 - RNA, 1898 nt, synthetic construct
  misc_feature 1..1898: note = mRNA product Design d-2 comprising derived and/or modified sequence from HRSV(A2)__F-del_DSCav1_mut4 (opt4)
  source 1..1898: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5099 - RNA, 1898 nt, synthetic construct
  misc_feature 1..1898: note = mRNA product Design d-2 comprising derived and/or modified sequence from HRSV(A2)__F-del_DSCav1_mut4 (opt5)
  source 1..1898: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5100 - RNA, 1898 nt, synthetic construct
  misc_feature 1..1898: note = mRNA product Design d-2 comprising derived and/or modified sequence from HRSV(A2)__F-del_DSCav1_mut4 (opt6)
  source 1..1898: mol_type = other RNA
gggagagcggctcggccattttgtcccagtcagtccggaggctgcggctgcagaagtaccgcctgcggagtaactgcaaagaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5101 - RNA, 1898 nt, synthetic construct
  misc_feature 1..1898: note = mRNA product Design d-2 comprising derived and/or modified sequence from HRSV(A2)__F-del_DSCav1_mut4 (opt11)
  source 1..1898: mol_type = other RNA
gggagagcggctcggccattttgtcccagtcagtccggaggctgcggctgcagaagtaccgcctgcggagtaactgcaaagaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5102 - RNA, 2214 nt, synthetic construct
  misc_feature 1..2214: note = mRNA product Design d-3 comprising derived and/or modified sequence from HRSV(A2)__F-del_DSCav1_mut4 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5103 - RNA, 2214 nt, synthetic construct
  misc_feature 1..2214: note = mRNA product Design d-3 comprising derived and/or modified sequence from HRSV(A2)__F-del_DSCav1_mut4 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5104 - RNA, 2214 nt, synthetic construct
  misc_feature 1..2214: note = mRNA product Design d-3 comprising derived and/or modified sequence from HRSV(A2)__F-del_DSCav1_mut4 (opt2)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5105 - RNA, 2214 nt, synthetic construct
  misc_feature 1..2214: note = mRNA product Design d-3 comprising derived and/or modified sequence from HRSV(A2)__F-del_DSCav1_mut4 (opt3)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5106 - RNA, 2214 nt, synthetic construct
  misc_feature 1..2214: note = mRNA product Design d-3 comprising derived and/or modified sequence from HRSV(A2)__F-del_DSCav1_mut4 (opt4)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5107 - RNA, 2214 nt, synthetic construct
  misc_feature 1..2214: note = mRNA product Design d-3 comprising derived and/or modified sequence from HRSV(A2)__F-del_DSCav1_mut4 (opt5)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5108 - RNA, 2214 nt, synthetic construct
  misc_feature 1..2214: note = mRNA product Design d-3 comprising derived and/or modified sequence from HRSV(A2)__F-del_DSCav1_mut4 (opt6)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5109 - RNA, 2214 nt, synthetic construct
  misc_feature 1..2214: note = mRNA product Design d-3 comprising derived and/or modified sequence from HRSV(A2)__F-del_DSCav1_mut4 (opt11)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5110 - RNA, 1897 nt, synthetic construct
  misc_feature 1..1897: note = mRNA product Design d-4 comprising derived and/or modified sequence from HRSV(A2)__F-del_DSCav1_mut4 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5111 - RNA, 1897 nt, synthetic construct
  misc_feature 1..1897: note = mRNA product Design d-4 comprising derived and/or modified sequence from HRSV(A2)__F-del_DSCav1_mut4 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5112 - RNA, 1897 nt, synthetic construct
  misc_feature 1..1897: note = mRNA product Design d-4 comprising derived and/or modified sequence from HRSV(A2)__F-del_DSCav1_mut4 (opt2)
  source 1..1897: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5113 - RNA, 1897 nt, synthetic construct
  misc_feature 1..1897: note = mRNA product Design d-4 comprising derived and/or modified sequence from HRSV(A2)__F-del_DSCav1_mut4 (opt3)
  source 1..1897: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5114 - RNA, 1897 nt, synthetic construct
  misc_feature 1..1897: note = mRNA product Design d-4 comprising derived and/or modified sequence from HRSV(A2)__F-del_DSCav1_mut4 (opt4)
  source 1..1897: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5115 - RNA, 1897 nt, synthetic construct
  misc_feature 1..1897: note = mRNA product Design d-4 comprising derived and/or modified sequence from HRSV(A2)__F-del_DSCav1_mut4 (opt5)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5116 - RNA, 1897 nt, synthetic construct
  misc_feature 1..1897: note = mRNA product Design d-4 comprising derived and/or modified sequence from HRSV(A2)__F-del_DSCav1_mut4 (opt6)
  source 1..1897: mol_type = other RNA
gggagagtcccgcagtcggcgtccagcggctctgcttgttcgtgtgtgtgtcgttgcaggccttattcaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5117 - RNA, 1897 nt, synthetic construct
  misc_feature 1..1897: note = mRNA product Design d-4 comprising derived and/or modified sequence from HRSV(A2)__F-del_DSCav1_mut4 (opt11)
  source 1..1897: mol_type = other RNA
gggagagtcccgcagtcggcgtccagcggctctgcttgttcgtgtgtgtgtcgttgcaggccttattcaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5118 - RNA, 1994 nt, synthetic construct
  misc_feature 1..1994: note = mRNA product Design d-5 comprising derived and/or modified sequence from HRSV(A2)__F-del_DSCav1_mut4 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5119 - RNA, 1994 nt, synthetic construct
  misc_feature 1..1994: note = mRNA product Design d-5 comprising derived and/or modified sequence from HRSV(A2)__F-del_DSCav1_mut4 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5120 - RNA, 1994 nt, synthetic construct
  misc_feature 1..1994: note = mRNA product Design d-5 comprising derived and/or modified sequence from HRSV(A2)__F-del_DSCav1_mut4 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5121 - RNA, 1994 nt, synthetic construct
  misc_feature 1..1994: note = mRNA product Design d-5 comprising derived and/or modified sequence from HRSV(A2)__F-del_DSCav1_mut4 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5122 - RNA, 1994 nt, synthetic construct
  misc_feature 1..1994: note = mRNA product Design d-5 comprising derived and/or modified sequence from HRSV(A2)__F-del_DSCav1_mut4 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5123 - RNA, 1994 nt, synthetic construct
  misc_feature 1..1994: note = mRNA product Design d-5 comprising derived and/or modified sequence from HRSV(A2)__F-del_DSCav1_mut4 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5124 - RNA, 1994 nt, synthetic construct
  misc_feature 1..1994: note = mRNA product Design d-5 comprising derived and/or modified sequence from HRSV(A2)__F-del_DSCav1_mut4 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5125 - RNA, 1994 nt, synthetic construct
  misc_feature 1..1994: note = mRNA product Design d-5 comprising derived and/or modified sequence from HRSV(A2)__F-del_DSCav1_mut4 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5126 - RNA, 1874 nt, synthetic construct
  misc_feature 1..1874: note = mRNA product Design e-1 comprising derived and/or modified sequence from HRSV(A2)__F-del_DSCav1_mut4 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5127 - RNA, 1874 nt, synthetic construct
  misc_feature 1..1874: note = mRNA product Design e-1 comprising derived and/or modified sequence from HRSV(A2)__F-del_DSCav1_mut4 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5128 - RNA, 1874 nt, synthetic construct
  misc_feature 1..1874: note = mRNA product Design e-1 comprising derived and/or modified sequence from HRSV(A2)__F-del_DSCav1_mut4 (opt2)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5129 - RNA, 1874 nt, synthetic construct
  misc_feature 1..1874: note = mRNA product Design e-1 comprising derived and/or modified sequence from HRSV(A2)__F-del_DSCav1_mut4 (opt3)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5130 - RNA, 1874 nt, synthetic construct
  misc_feature 1..1874: note = mRNA product Design e-1 comprising derived and/or modified sequence from HRSV(A2)__F-del_DSCav1_mut4 (opt4)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5131 - RNA, 1874 nt, synthetic construct
  misc_feature 1..1874: note = mRNA product Design e-1 comprising derived and/or modified sequence from HRSV(A2)__F-del_DSCav1_mut4 (opt5)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5132 - RNA, 1874 nt, synthetic construct
  misc_feature 1..1874: note = mRNA product Design e-1 comprising derived and/or modified sequence from HRSV(A2)__F-del_DSCav1_mut4 (opt6)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5133 - RNA, 1874 nt, synthetic construct
  misc_feature 1..1874: note = mRNA product Design e-1 comprising derived and/or modified sequence from HRSV(A2)__F-del_DSCav1_mut4 (opt11)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5134 - RNA, 1856 nt, synthetic construct
  misc_feature 1..1856: note = mRNA product Design e-2 comprising derived and/or modified sequence from HRSV(A2)__F-del_DSCav1_mut4 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5135 - RNA, 1856 nt, synthetic construct
  misc_feature 1..1856: note = mRNA product Design e-2 comprising derived and/or modified sequence from HRSV(A2)__F-del_DSCav1_mut4 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5136 - RNA, 1856 nt, synthetic construct
  misc_feature 1..1856: note = mRNA product Design e-2 comprising derived and/or modified sequence from HRSV(A2)__F-del_DSCav1_mut4 (opt2)
  source 1..1856: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5137 - RNA, 1856 nt, synthetic construct
  misc_feature 1..1856: note = mRNA product Design e-2 comprising derived and/or modified sequence from HRSV(A2)__F-del_DSCav1_mut4 (opt3)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5138 - RNA, 1856 nt, synthetic construct
  misc_feature 1..1856: note = mRNA product Design e-2 comprising derived and/or modified sequence from HRSV(A2)__F-del_DSCav1_mut4 (opt4)
  source 1..1856: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5139 - RNA, 1856 nt, synthetic construct
  misc_feature 1..1856: note = mRNA product Design e-2 comprising derived and/or modified sequence from HRSV(A2)__F-del_DSCav1_mut4 (opt5)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5140 - RNA, 1856 nt, synthetic construct
  misc_feature 1..1856: note = mRNA product Design e-2 comprising derived and/or modified sequence from HRSV(A2)__F-del_DSCav1_mut4 (opt6)
  source 1..1856: mol_type = other RNA
gggagacccgtgacccggaagttgtacggctacgcgactttccctcccacaaaccctcgcgcccttcctttcctacttgggcccggcagaaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5141 - RNA, 1856 nt, synthetic construct
  misc_feature 1..1856: note = mRNA product Design e-2 comprising derived and/or modified sequence from HRSV(A2)__F-del_DSCav1_mut4 (opt11)
  source 1..1856: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5142 - RNA, 1826 nt, synthetic construct
  misc_feature 1..1826: note = mRNA product Design e-3 comprising derived and/or modified sequence from HRSV(A2)__F-del_DSCav1_mut4 (opt1)
  source 1..1826: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5143 - RNA, 1826 nt, synthetic construct
  misc_feature 1..1826: note = mRNA product Design e-3 comprising derived and/or modified sequence from HRSV(A2)__F-del_DSCav1_mut4 (opt1)
  source 1..1826: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5144 - RNA, 1826 nt, synthetic construct
  misc_feature 1..1826: note = mRNA product Design e-3 comprising derived and/or modified sequence from HRSV(A2)__F-del_DSCav1_mut4 (opt2)
  source 1..1826: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5145 - RNA, 1826 nt, synthetic construct
  misc_feature 1..1826: note = mRNA product Design e-3 comprising derived and/or modified sequence from HRSV(A2)__F-del_DSCav1_mut4 (opt3)
  source 1..1826: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5146 - RNA, 1826 nt, synthetic construct
  misc_feature 1..1826: note = mRNA product Design e-3 comprising derived and/or modified sequence from HRSV(A2)__F-del_DSCav1_mut4 (opt4)
  source 1..1826: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5147 - RNA, 1826 nt, synthetic construct
  misc_feature 1..1826: note = mRNA product Design e-3 comprising derived and/or modified sequence from HRSV(A2)__F-del_DSCav1_mut4 (opt5)
  source 1..1826: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5148 - RNA, 1826 nt, synthetic construct
  misc_feature 1..1826: note = mRNA product Design e-3 comprising derived and/or modified sequence from HRSV(A2)__F-del_DSCav1_mut4 (opt6)
  source 1..1826: mol_type = other RNA
gggagactttcccattctgtagcagaatttggtgttgcctgtggtcttggtcccgcggagaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5149 - RNA, 1826 nt, synthetic construct
  misc_feature 1..1826: note = mRNA product Design e-3 comprising derived and/or modified sequence from HRSV(A2)__F-del_DSCav1_mut4 (opt11)
  source 1..1826: mol_type = other RNA
gggagactttcccattctgtagcagaatttggtgttgcctgtggtcttggtcccgcggagaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5150 - RNA, 1880 nt, synthetic construct
  misc_feature 1..1880: note = mRNA product Design e-4 comprising derived and/or modified sequence from HRSV(A2)__F-del_DSCav1_mut4 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5151 - RNA, 1880 nt, synthetic construct
  misc_feature 1..1880: note = mRNA product Design e-4 comprising derived and/or modified sequence from HRSV(A2)__F-del_DSCav1_mut4 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5152 - RNA, 1880 nt, synthetic construct
  misc_feature 1..1880: note = mRNA product Design e-4 comprising derived and/or modified sequence from HRSV(A2)__F-del_DSCav1_mut4 (opt2)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5153 - RNA, 1880 nt, synthetic construct
  misc_feature 1..1880: note = mRNA product Design e-4 comprising derived and/or modified sequence from HRSV(A2)__F-del_DSCav1_mut4 (opt3)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5154 - RNA, 1880 nt, synthetic construct
  misc_feature 1..1880: note = mRNA product Design e-4 comprising derived and/or modified sequence from HRSV(A2)__F-del_DSCav1_mut4 (opt4)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5155 - RNA, 1880 nt, synthetic construct
  misc_feature 1..1880: note = mRNA product Design e-4 comprising derived and/or modified sequence from HRSV(A2)__F-del_DSCav1_mut4 (opt5)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5156 - RNA, 1880 nt, synthetic construct
  misc_feature 1..1880: note = mRNA product Design e-4 comprising derived and/or modified sequence from HRSV(A2)__F-del_DSCav1_mut4 (opt6)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5157 - RNA, 1880 nt, synthetic construct
  misc_feature 1..1880: note = mRNA product Design e-4 comprising derived and/or modified sequence from HRSV(A2)__F-del_DSCav1_mut4 (opt11)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5158 - RNA, 1847 nt, synthetic construct
  misc_feature 1..1847: note = mRNA product Design e-5 comprising derived and/or modified sequence from HRSV(A2)__F-del_DSCav1_mut4 (opt1)
  source 1..1847: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5159 - RNA, 1847 nt, synthetic construct
  misc_feature 1..1847: note = mRNA product Design e-5 comprising derived and/or modified sequence from HRSV(A2)__F-del_DSCav1_mut4 (opt1)
  source 1..1847: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5160 - RNA, 1847 nt, synthetic construct
  misc_feature 1..1847: note = mRNA product Design e-5 comprising derived and/or modified sequence from HRSV(A2)__F-del_DSCav1_mut4 (opt2)
  source 1..1847: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5161 - RNA, 1847 nt, synthetic construct
  misc_feature 1..1847: note = mRNA product Design e-5 comprising derived and/or modified sequence from HRSV(A2)__F-del_DSCav1_mut4 (opt3)
  source 1..1847: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5162 - RNA, 1847 nt, synthetic construct
  misc_feature 1..1847: note = mRNA product Design e-5 comprising derived and/or modified sequence from HRSV(A2)__F-del_DSCav1_mut4 (opt4)
  source 1..1847: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5163 - RNA, 1847 nt, synthetic construct
  misc_feature 1..1847: note = mRNA product Design e-5 comprising derived and/or modified sequence from HRSV(A2)__F-del_DSCav1_mut4 (opt5)
  source 1..1847: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5164 - RNA, 1847 nt, synthetic construct
  misc_feature 1..1847: note = mRNA product Design e-5 comprising derived and/or modified sequence from HRSV(A2)__F-del_DSCav1_mut4 (opt6)
  source 1..1847: mol_type = other RNA
gggagagcggctcggccattttgtcccagtcagtccggaggctgcggctgcagaagtaccgcctgcggagtaactgcaaagaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5165 - RNA, 1847 nt, synthetic construct
  misc_feature 1..1847: note = mRNA product Design e-5 comprising derived and/or modified sequence from HRSV(A2)__F-del_DSCav1_mut4 (opt11)
  source 1..1847: mol_type = other RNA
gggagagcggctcggccattttgtcccagtcagtccggaggctgcggctgcagaagtaccgcctgcggagtaactgcaaagaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5166 - RNA, 1914 nt, synthetic construct
  misc_feature 1..1914: note = mRNA product Design e-6 comprising derived and/or modified sequence from HRSV(A2)__F-del_DSCav1_mut4 (opt1)
  source 1..1914: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5167 - RNA, 1914 nt, synthetic construct
  misc_feature 1..1914: note = mRNA product Design e-6 comprising derived and/or modified sequence from HRSV(A2)__F-del_DSCav1_mut4 (opt1)
  source 1..1914: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5168 - RNA, 1914 nt, synthetic construct
  misc_feature 1..1914: note = mRNA product Design e-6 comprising derived and/or modified sequence from HRSV(A2)__F-del_DSCav1_mut4 (opt2)
  source 1..1914: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5169 - RNA, 1914 nt, synthetic construct
  misc_feature 1..1914: note = mRNA product Design e-6 comprising derived and/or modified sequence from HRSV(A2)__F-del_DSCav1_mut4 (opt3)
  source 1..1914: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5170 - RNA, 1914 nt, synthetic construct
  misc_feature 1..1914: note = mRNA product Design e-6 comprising derived and/or modified sequence from HRSV(A2)__F-del_DSCav1_mut4 (opt4)
  source 1..1914: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5171 - RNA, 1914 nt, synthetic construct
  misc_feature 1..1914: note = mRNA product Design e-6 comprising derived and/or modified sequence from HRSV(A2)__F-del_DSCav1_mut4 (opt5)
  source 1..1914: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5172 - RNA, 1914 nt, synthetic construct
  misc_feature 1..1914: note = mRNA product Design e-6 comprising derived and/or modified sequence from HRSV(A2)__F-del_DSCav1_mut4 (opt6)
  source 1..1914: mol_type = other RNA
gggagagcggctcggccattttgtcccagtcagtccggaggctgcggctgcagaagtaccgcctgcggagtaactgcaaagaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5173 - RNA, 1914 nt, synthetic construct
  misc_feature 1..1914: note = mRNA product Design e-6 comprising derived and/or modified sequence from HRSV(A2)__F-del_DSCav1_mut4 (opt11)
  source 1..1914: mol_type = other RNA
gggagagcggctcggccattttgtcccagtcagtccggaggctgcggctgcagaagtaccgcctgcggagtaactgcaaagaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5174 - RNA, 2130 nt, synthetic construct
  misc_feature 1..2130: note = mRNA product Design f-1 comprising derived and/or modified sequence from HRSV(A2)__F-del_DSCav1_mut4 (opt1)
  source 1..2130: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5175 - RNA, 2130 nt, synthetic construct
  misc_feature 1..2130: note = mRNA product Design f-1 comprising derived and/or modified sequence from HRSV(A2)__F-del_DSCav1_mut4 (opt1)
  source 1..2130: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5176 - RNA, 2130 nt, synthetic construct
  misc_feature 1..2130: note = mRNA product Design f-1 comprising derived and/or modified sequence from HRSV(A2)__F-del_DSCav1_mut4 (opt2)
  source 1..2130: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5177 - RNA, 2130 nt, synthetic construct
  misc_feature 1..2130: note = mRNA product Design f-1 comprising derived and/or modified sequence from HRSV(A2)__F-del_DSCav1_mut4 (opt3)
  source 1..2130: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5178 - RNA, 2130 nt, synthetic construct
  misc_feature 1..2130: note = mRNA product Design f-1 comprising derived and/or modified sequence from HRSV(A2)__F-del_DSCav1_mut4 (opt4)
  source 1..2130: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5179 - RNA, 2130 nt, synthetic construct
  misc_feature 1..2130: note = mRNA product Design f-1 comprising derived and/or modified sequence from HRSV(A2)__F-del_DSCav1_mut4 (opt5)
  source 1..2130: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5180 - RNA, 2130 nt, synthetic construct
  misc_feature 1..2130: note = mRNA product Design f-1 comprising derived and/or modified sequence from HRSV(A2)__F-del_DSCav1_mut4 (opt6)
  source 1..2130: mol_type = other RNA
gggagagcggctcggccattttgtcccagtcagtccggaggctgcggctgcagaagtaccgcctgcggagtaactgcaaagaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5181 - RNA, 2130 nt, synthetic construct
  misc_feature 1..2130: note = mRNA product Design f-1 comprising derived and/or modified sequence from HRSV(A2)__F-del_DSCav1_mut4 (opt11)
  source 1..2130: mol_type = other RNA
gggagagcggctcggccattttgtcccagtcagtccggaggctgcggctgcagaagtaccgcctgcggagtaactgcaaagaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5182 - RNA, 1910 nt, synthetic construct
  misc_feature 1..1910: note = mRNA product Design f-2 comprising derived and/or modified sequence from HRSV(A2)__F-del_DSCav1_mut4 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5183 - RNA, 1910 nt, synthetic construct
  misc_feature 1..1910: note = mRNA product Design f-2 comprising derived and/or modified sequence from HRSV(A2)__F-del_DSCav1_mut4 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5184 - RNA, 1910 nt, synthetic construct
  misc_feature 1..1910: note = mRNA product Design f-2 comprising derived and/or modified sequence from HRSV(A2)__F-del_DSCav1_mut4 (opt2)
  source 1..1910: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5185 - RNA, 1910 nt, synthetic construct
  misc_feature 1..1910: note = mRNA product Design f-2 comprising derived and/or modified sequence from HRSV(A2)__F-del_DSCav1_mut4 (opt3)
  source 1..1910: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5186 - RNA, 1910 nt, synthetic construct
  misc_feature 1..1910: note = mRNA product Design f-2 comprising derived and/or modified sequence from HRSV(A2)__F-del_DSCav1_mut4 (opt4)
  source 1..1910: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5187 - RNA, 1910 nt, synthetic construct
  misc_feature 1..1910: note = mRNA product Design f-2 comprising derived and/or modified sequence from HRSV(A2)__F-del_DSCav1_mut4 (opt5)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5188 - RNA, 1910 nt, synthetic construct
  misc_feature 1..1910: note = mRNA product Design f-2 comprising derived and/or modified sequence from HRSV(A2)__F-del_DSCav1_mut4 (opt6)
  source 1..1910: mol_type = other RNA
gggagagcggctcggccattttgtcccagtcagtccggaggctgcggctgcagaagtaccgcctgcggagtaactgcaaagaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5189 - RNA, 1910 nt, synthetic construct
  misc_feature 1..1910: note = mRNA product Design f-2 comprising derived and/or modified sequence from HRSV(A2)__F-del_DSCav1_mut4 (opt11)
  source 1..1910: mol_type = other RNA
gggagagcggctcggccattttgtcccagtcagtccggaggctgcggctgcagaagtaccgcctgcggagtaactgcaaagaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5190 - RNA, 1901 nt, synthetic construct
  misc_feature 1..1901: note = mRNA product Design f-3 comprising derived and/or modified sequence from HRSV(A2)__F-del_DSCav1_mut4 (opt1)
  source 1..1901: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5191 - RNA, 1901 nt, synthetic construct
  misc_feature 1..1901: note = mRNA product Design f-3 comprising derived and/or modified sequence from HRSV(A2)__F-del_DSCav1_mut4 (opt1)
  source 1..1901: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5192 - RNA, 1901 nt, synthetic construct
  misc_feature 1..1901: note = mRNA product Design f-3 comprising derived and/or modified sequence from HRSV(A2)__F-del_DSCav1_mut4 (opt2)
  source 1..1901: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5193 - RNA, 1901 nt, synthetic construct
  misc_feature 1..1901: note = mRNA product Design f-3 comprising derived and/or modified sequence from HRSV(A2)__F-del_DSCav1_mut4 (opt3)
  source 1..1901: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5194 - RNA, 1901 nt, synthetic construct
  misc_feature 1..1901: note = mRNA product Design f-3 comprising derived and/or modified sequence from HRSV(A2)__F-del_DSCav1_mut4 (opt4)
  source 1..1901: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5195 - RNA, 1901 nt, synthetic construct
  misc_feature 1..1901: note = mRNA product Design f-3 comprising derived and/or modified sequence from HRSV(A2)__F-del_DSCav1_mut4 (opt5)
  source 1..1901: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5196 - RNA, 1901 nt, synthetic construct
  misc_feature 1..1901: note = mRNA product Design f-3 comprising derived and/or modified sequence from HRSV(A2)__F-del_DSCav1_mut4 (opt6)
  source 1..1901: mol_type = other RNA
gggagagtcccgcagtcggcgtccagcggctctgcttgttcgtgtgtgtgtcgttgcaggccttattcaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt
